United States Patent
Joseloff et al.

(10) Patent No.: US 7,608,413 B1
(45) Date of Patent: Oct. 27, 2009

(54) KIDNEY DISEASE TARGETS AND USES THEREOF

(75) Inventors: Elizabeth Joseloff, Silverspring, MD (US); Steve Ruben, Brookeville, MD (US); Tao He, North Potomac, MD (US); Yeoun Jim Kim, Rockville, MD (US)

(73) Assignee: Celera Corporation, Alameda, CA (US)

(*) Notice: Subject to any disclaimer, the term of this patent is extended or adjusted under 35 U.S.C. 154(b) by 131 days.

(21) Appl. No.: 11/878,050

(22) Filed: Jul. 20, 2007

Related U.S. Application Data

(63) Continuation of application No. 11/385,692, filed on Mar. 22, 2006, now abandoned.

(60) Provisional application No. 60/664,936, filed on Mar. 25, 2005, provisional application No. 60/680,002, filed on May 12, 2005, provisional application No. 60/701,038, filed on Jul. 21, 2005, provisional application No. 60/717,195, filed on Sep. 16, 2005, provisional application No. 60/742,873, filed on Dec. 7, 2005, provisional application No. 60/763,347, filed on Jan. 31, 2006.

(51) Int. Cl.
*G01N 33/574* (2006.01)
*A61K 39/395* (2006.01)
*A61K 39/00* (2006.01)

(52) U.S. Cl. .................. 435/7.23; 424/130.1; 424/178.1

(58) Field of Classification Search .................. None
See application file for complete search history.

(56) References Cited

FOREIGN PATENT DOCUMENTS

| WO | WO 0055318 A2 * | 9/2000 |
| WO | WO 0250114 A2 * | 6/2002 |

OTHER PUBLICATIONS

Lomri, Fitz, and Scharschmidt. Hepatocellular transport: role of ATP-binding cassete proteins. Seminars in Liver Disease, 1996. vol. 16, pp. 201-210.*

* cited by examiner

*Primary Examiner*—David J. Blanchard
*Assistant Examiner*—Anne M. Gussow

(57) ABSTRACT

The present invention provides a method for diagnosing and detecting diseases associated with kidney. The present invention provides one or more proteins or fragments thereof, peptides or nucleic acid molecules differentially expressed in kidney diseases (KCAT) and antibodies binds to KCATs. The present invention provides that KCATs are used as targets for screening agents that modulates the KCAT activities. Further the present invention provides methods for treating diseases associated with kidney.

4 Claims, No Drawings

KIDNEY DISEASE TARGETS AND USES THEREOF

FIELD OF THE INVENTION

This invention relates to the fields of molecular biology and oncology. Specifically, the invention provides a molecular marker and a therapeutic agent for use in the diagnosis and treatment of kidney diseases.

BACKGROUND OF THE INVENTION

The American Cancer Society estimates that there will be about 36,160 new cases of kidney cancer (22,490 in men and 13,670 in women) in the United States in the year 2005, and about 12,660 people (8,020 men and 4,640 women) will die from this disease. Kidney cancer (also referred to as renal cancer or renal cell carcinoma) mostly affects adults between 50 and 70 years of age. If detected early, kidney cancer is curable. However, symptoms may not appear until the tumor has grown to a large size or metastasized to other organs, at which point treatment is difficult.

The 5-year survival rate for individuals diagnosed with kidney cancer is about 90% for those individuals whose tumor is confined to the kidney, about 60% if it has only spread to nearby tissues, and about 9% if it has spread to distant sites (American Cancer Society, *Detailed Guide: Kidney Cancer*. "What Are the Key Statistics for Kidney Cancer (Renal Cell Carcinoma)?").

The majority of kidney cancers are renal cell carcinomas (which accounts for over 90% of malignant kidney tumors), also known as renal adenocarcinomas or clear cell carcinomas. There are five main types of renal cell carcinoma that are identified based on microscopic examination of cell type: clear cell, papillary, chromophobe, collecting duct, and "unclassified." Kidney cancers are also usually graded on a scale of 1 through 4 to indicate how similar the nuclei of the cancer cells are to the nuclei of normal kidney cells (grade 1 renal cell cancers have cell nuclei that differ very little from normal kidney cell nuclei and generally have a good prognosis, whereas grade 4 renal cell cancer nuclei look considerably different from normal kidney cell nuclei and have a worse prognosis). In addition to grade, kidney cancers are also characterized by stage, which staging system is that of the American Joint Committee on Cancer (AJCC) (also referred to as the TNM system), although the Robson classification is an older system that may be occasionally used.

In additional to renal cell carcinomas, other types of kidney cancers include transitional cell carcinomas, Wilms tumors, and renal sarcomas. Wilms tumors are the most common type of kidney cancer in children and are extremely rare in adults. Benign (non-metastasizing) kidney tumors include renal cell adenomas, renal oncocytomas, and angiomyolipomas (American Cancer Society, *Detailed Guide: Kidney Cancer*. "What Is Kidney Cancer (Renal Cell Carcinoma)?").

Risk factors for kidney cancer include the following: age older than 50 years; male (men are twice as likely to get kidney cancer compared to women); cigarette smoking; exposure to asbestos, cadmium, or organic solvents; obesity; a high-fat diet; and von Hippel-Lindau disease (a genetic condition that has a high incidence of kidney cancer).

Symptoms of kidney cancer include hematuria (blood in the urine), abdominal or low back pain, weight loss, fatigue, anemia, fever, high blood pressure, and leg or ankle swelling.

In addition to a detailed medical history, physical examination, and laboratory blood testing, diagnosis of kidney cancer may typically include a computed tomography (CT) scan, ultrasound, magnetic resonance imaging (MRI), intravenous pyelography (a kidney test that utilizes dye and x-rays), or arteriography (a test in which dye is applied to the blood vessels feeding the kidney). To detect metastatic disease, chest X-ray and bone scan may be implemented.

Treatment of kidney cancer in individuals whose tumor is confined to the kidney may involve surgical removal of the kidney (nephrectomy) and surrounding tissue. Radiation therapy may be applied to treat pain and advanced or metastatic kidney cancers or to help shrink a tumor that is causing obstruction. Immunotherapy, such as interferon and interleukin-2, may be used to boost the immune system in patients with advanced kidney cancer (*Journal of the American Medical Association*, JAMA Patient Page: Kidney Cancer).

One promising method for early diagnosis of various forms of cancer is the identification of specific biochemical moieties, termed "targets", expressed differentially in the cancerous cells. The targets are either cell surface proteins, secreted proteins, or cytosolic proteins. Antibodies which will specifically recognize and bind to the targets in the cancerous cells potentially provide powerful tools for the diagnosis and treatment of the particular malignancy.

SUMMARY OF THE INVENTION

The present invention is based on the identification of certain cell surface proteins, secreted proteins, and/or cytosolic proteins that are differentially expressed in kidney disease. A malignant cell often differs from a normal cell by a differential expression of one or more proteins. These differentially expressed proteins, and the fragments thereof, are important markers for the diagnosis of kidney disease. The differentially expressed proteins of the present invention and the nucleic acids encoding said proteins and the fragments of said proteins are referred to herein as kidney cancer associated target, KCAT proteins or KCAT nucleic acids or KCAT peptides, respectively.

The present invention provides peptides and protein differentially expressed in kidney diseases (hereinafter KCAT). Based on the site of protein localization, e.g., surface, secreted, or cytosolic, and protein characterization, e.g. receptor or enzyme, specific uses of these KCATs are provided. Some of the KCATs of the present invention serve as targets for one or more classes of theraputic agents, while others may be suitable for antibody theraputics.

Accordingly, the present invention provides a method for diagnosing or detecting kidney disease in a subject comprising: determining the level of one or more KCAT proteins, or any fragment(s) thereof, in a test sample from said subject, wherein said KCAT protein comprises a sequence selected from a group consisting of SEQ ID NOS: 1-2736; wherein a differential level of said KCAT protein(s) or fragment(s) in said sample relative to the level of said protein(s) or fragment(s) in a test sample from a healthy subject, or the level established for a healthy subject, is indicative of kidney disease.

The present invention also provides a method for detecting kidney cancer in a subject comprising: determining the level of one or more KCAT peptide(s) comprising a peptide sequence selected from a group consisting of SEQ ID NOS: 5165-6044 in a test sample from said subject, wherein a differential level of said KCAT peptide(s) in said sample to the level of said KCAT peptide(s) in a test sample from a healthy subject, or the level of said KCAT peptide(s) established for a healthy subject, is indicative of kidney disease.

The present invention further provides a method for detecting kidney disease in a subject comprising: determining the level of one or more KCAT nucleic acid(s), or any fragment(s)

thereof, in a test sample from said subject, wherein said KCAT nucleic acid(s) encode a KCAT protein sequence selected from a group consisting of SEQ ID NOS: 1-2736; wherein a differential level of said KCAT nucleic acids or fragment(s) in said sample relative to the level of said protein(s) or fragment(s) in a test sample from a healthy subject, or the level established for a healthy subject, is indicative of kidney disease.

The invention also provides methods for detecting the KCAT peptides, gene or mRNA in a test sample for use in diagnosing the presence, absence or progression of a disease. The test sample includes but is not limited to a biological sample such as tissue, blood, serum or biological fluid.

The present invention further provides a purified antibody that binds specifically to a protein molecule, or any fragment thereof, selected from a group consisting of SEQ ID NOS: 1-2736.

The present invention further provides a composition comprising an antibody that binds to a protein selected from a group consisting of SEQ ID NOS: 1-2736, and an acceptable carrier.

The present invention further provides a method for treating kidney disease, comprising administering to a patient in need of said treatment a therapeutically effective amount of one or more antibody(ies) of this invention.

The present invention further provides a method for treating kidney disease comprising (i) identifying a subject having kidney disease and (ii) administering to a said patient a therapeutically effective amount of one or more antibody(ies) of this invention.

The present invention further provides a method to screen for agents that modulate KCAT protein activity, comprising the steps of (i) contacting a test agent with a KCAT protein and (ii) assaying for KCAT protein activity, wherein a change in said activity in the presence of said agent relative to KCAT protein activity in the absence of said agent indicates said agent modulates said KCAT protein activity.

The present invention further provides a method to screen for agents that bind to KCAT protein, comprising the steps of (i) contacting a test agent with a KCAT protein and (ii) measuring the level of binding of agent to said KCAT protein.

The invention also provides diagnostic methods for human disease, in particular for kidney diseases, its metastatic stage, and therapeutic potential.

The invention also provides a method for monitoring the disease progression and the treatment progress.

The invention further provide a method of diagnosis by an array, wherein the array is immobilized with two or more KCAT proteins, peptides or nucleic acid molecules. The proteins, peptides or nucleic acid molecules include but are not limited to the SEQ ID NOS: 1-2736.

The invention also provides monoclonal or polyclonal antibodies and composition thereof reactive with antigentic portion of KCAT protein, peptides or fragments thereof in a form for use in kidney diseases diagnosis.

The invention further provides an immunogenic antibody for treating kidney diseases disease or diseases associated with kidney diseases.

The present invention provides a method for screening agents that modulate KCAT activity, comprising the steps of (a) contacting a sample comprising KCAT with an agent; and (b) assaying for KCAT activity, wherein a change in said KCAT activity in the presence of said agent relative to KCAT activity in the absence of said compound indicates said agent modulates KCAT. The agents include but are not limited to protein, peptide, antibody, nucleic acid such as antisense RNA, RNAi fragments, small molecules.

The present invention further provides a method for treating kidney diseases, comprising: administering to a patient with one or more agents in a therapeutically effective amount to treat kidney diseases.

The present invention provides a method for treating kidney diseases, comprising: identifying a subject having kidney diseases; and administering to a patient to one or more antibodies in a therapeutically effective amount to treat kidney diseases.

Description of the Files Contained on the CD-R Named CL001591CDR

The CD-R named CL001591CDR contains the following three text (ASCII) files:

1) File SEQLIST_1591 txt provides the Sequence Listing. The Sequence Listing provides the protein sequences (SEQ ID NOS: 1-2736); transcript sequences (SEQ ID NOS: 2737-5164) and peptide sequences (SEQ ID NOS: 5165-6044) as shown in Table 1. File SEQLIST_1591.txt is 25,151 KB in size.

2) File TABLE1_1591CON.txt provides Table 1. File TABLE1_1591CON.is 930 KB in size.

The material contained on the CD-R labeled CL001591CDR is hereby incorporated by reference pursuant to 37 CFR 1.77(b)(4).

Description of Table 1

Table 1 (provided on the CD-R) discloses the KCAT proteins, transcripts, and peptides sequences.

The transcript/protein information includes:
a protein number (1 through 2736)
a Celera protein internal identification number for the protein encoded by the Celera transcript (hCP and/or UID)
a public protein accession number (Genbank e.g., RefSeq NP number, Swiss-prot, or Derwent) for the protein
an art-known gene/protein name
a Celera transcript internal identification number (hCT and/or UID)
a public transcript accession number (Genbank e.g., RefSeq NM number, or Derwent)
a Celera hCG and UID internal identification numbers for the gene
an art-known gene symbol
Celera genomic axis position (indicating start nucleotide position-stop nucleotide position)
the chromosome number of the chromosome on which the gene is located
an OMIM (Online Mendelian Inheritance in Man; Johns Hopkins University/NCBI) public reference number for obtaining further information regarding the medical significance of each gene
alternative gene/protein name(s) and/or symbol(s) in the OMIM entry Table 1 also discloses the peptides which correspond to the protein, the kidney cancer cell lines and kidney tumor tissues ("source"), the expression information, the ratio compare to the control sample. The expression is based on measuring the level of the peptides. Numerical representation of overexpression is indicated by more than two, whereas numerical representation of underexpression is indicated by less than 0.5. Over expressed singleton indicates that the peptide peak in diseased sample was detected and there was no peak detected in control samples. Under expressed singleton indicates that the peptide peak was detected in the control sample and there was no peak in the diseased sample.

Description of Table 2

Table 2 discloses tumor staging information as follows (all tumor staging designations in Table 2 are those which are typically used in the art): Sample ID Number, sample type (labeled "Sample"), cancer type (labeled "Type"), Lymph Nodes (the "N" in the TNM staging system, for Node, which designates the spread of a tumor to the lymph nodes), Distant Metastasis (the "M" in the TNM staging system, for Metastasis, which designates the extent of tumor metastasis), Extent of Invasion (the "T" in the TNM staging system, for Tumor, which designates the size and location of a primary tumor), and AJCC Stage (which is assigned based on a combination of the T, N, and M classifications).

The Lymph Nodes ("N") stages are as follows: "NX"=the regional lymph nodes cannot be assessed, "N0"=no cancer was found in the regional lymph nodes, "N1"=the cancer has spread to a single regional lymph node area, and "N2"=the cancer has spread to more than one regional lymph node area.

The Distant Metastasis ("M") stages are as follows: "MX"=distant spread cannot be assessed, "M0"=the disease has not metastasized, and "M1"=there is metastasis to another part of the body beyond the kidney area.

The Extent of Invasion ("T") stages are as follows: "TX"=the primary tumor cannot be evaluated, "T0"=there is no evidence of a primary tumor in the kidney(s), "T1"=the tumor is found only in the kidney and is 7 cm or smaller in size at its greatest dimension, "T1a"=the tumor is found only in the kidney and is 4 cm or smaller in size at its greatest dimension, "T1b"=the tumor is found only in the kidney and is between 4 cm and 7 cm in size at its greatest dimension, "T2"=the tumor is found only in the kidney and is larger than 7 cm in size at its greatest dimension, "T3"=the tumor has grown into major veins or it has invaded the adrenal gland or perinephric tissues, but the tumor has not reached beyond Gerota's fascia, "T3a"=the tumor has invaded the adrenal gland or perinephric tissues, but the tumor has not spread beyond Gerota's fascia, "T3b"=the tumor extends into the renal vein(s) or vena cava below the diaphragm, "T3c"=the tumor extends into the renal vein(s) or vena cava above the diaphragm, and "T4"=the tumor has invaded areas beyond Gerota's fascia.

The AJCC Stages are as follows: "I"=the tumor is 7 cm or smaller and is in the kidney only and has not invaded the lymph nodes or distant organs of the body (T1, N0, M0), "II"=the tumor is larger than 7 cm and is in the kidney only and has not invaded the lymph nodes or distant organs of the body (T2, N0, M0), "III"=the tumor has spread to one nearby lymph node but not distant lymph nodes or other organs (T1, T2, T3; N0; M0) or the tumor has spread to fatty tissue around the kidney and/or has spread into the renal vein but has not spread to any lymph nodes or other organs (T1, T2, T3; N1; M0), "IV"=the tumor has spread directly through the fatty tissue and the fascia, possibly to lymph nodes, but not to other parts of the body (T4; N0, N1; M0) or the tumor has spread to more than one lymph node area near the kidney but not to other parts of the body (any T, N2, M0) or the tumor has spread to any other organ, such as the lungs, bones, or the brain (any T, any N, M0), and "Recurrent"=the cancer has returned to the kidney area or another part of the body following treatment.

DETAILED DESCRIPTION OF THE PREFERRED EMBODIMENTS

General Description

While the broadest definition of this invention is set forth in the Summary of the Invention, certain nucleic acids, peptides or proteins are preferred. For example a preferred method for detecting kidney disease by determining the level of one or more KCAT protein(s) or any fragment(s) thereof is wherein the level of KCAT protein(s) are determined by contacting one or more antibody(ies) that specifically bind to the antigenic regions of the KCAT protein(s). Further preferred is a method wherein the level of two or more proteins are determined, more preferred wherein the level of four or more proteins are determined and most preferred wherein the level of eight or more proteins are determined.

A preferred method for detecting kidney disease by determining the level of one or more KCAT peptide(s) is wherein the level of KCAT peptides(s) are determined by contacting one or more antibody(ies) that specifically bind to the antigenic regions of the KCAT peptide(s). Further preferred is a method wherein the level of five or more peptides are determined, more preferred wherein the level of ten or more peptides are determined and most preferred wherein the level of fifteen or more peptides are determined.

A preferred method for detecting kidney disease by determining the level of one or more KCAT nucleic acid(s) is wherein the level of said KCAT nucleic acid(s) is determined by contacting one or more probes that specifically hybridize to said nucleic acid(s). Further preferred is a method wherein the level of two or more nucleic acids are determined, more preferred wherein the level of four or more nucleic acids are determined and most preferred wherein the level of eight or more nucleic acids are determined.

The methods for detecting kidney disease provided by the present invention may be used for diagnosing the presence of disease in a patent, monitoring the presence of kidney disease in patients undergoing treatment and testing for the reoccurrence of kidney disease in patients that were successfully treated for kidney disease; preferably wherein the kidney disease is kidney cancer. The test sample may be, but is not limited to, a biological sample such as tissue, blood, serum or biological fluid.

The present invention is based on the discovery of protein(s) and peptide(s) that are differentially expressed in kidney diseases cancer samples versus normal kidney diseases samples. These proteins and peptide, and the encoding nucleic acid molecules are associated with kidney diseases, hereinafter the KCAT protein, peptide or nucleic acids.

The discovery of disease specific target proteins is base on discoveries made using proteomics techniques. The method uses on MALDI-TOF LC/MS analyses platform to generate protein expression profiles from kidney diseases tissues or cell lines in an effort to discover and identify novel molecules associated with the disease.

Based on these discoveries, the present invention provides proteins, peptides, nucleic acids that are differential in kidney diseases, as well as antibodies binds to the proteins or peptides. The present invention also provides methods for detection, monitoring, diagnosis, prognosis, preventive and treatment of kidney diseases. The present invention provides a detection reagent, markers for kidney diseases at various stages, comprises KCAT sequences isolated from human kidney diseases tissue, sera, cell lines, blood or biological fluids.

The present invention provides a method for treating kidney diseases targeting at KCAT. The treatment includes administration of a therapeutically effective amount of composition comprising, but not limit to, an antibody, an immunogentic peptide which induces T cell response, a small molecule, a protein or a nucleic acid molecule. The composition further comprises an agonist or antigonist to KCAT.

The present invention may further provide a diagnostic or therapeutic potential for epithelial-cell related cancers, which include but are not limited to kidney, pancreas, lung, colon, prostate, ovarian, breast, bladder, hepatocellular, pharyngeal and gastric cancers The present invention further provides the target for screening an agent for KCAT, wherein the agent is compounds of small molecules, proteins, peptides, nucleic acids, antibodies or other agonists or antigonists.

KCAT Peptide/Proteins and Peptides

The present invention provides isolated KCAT peptide and protein molecules that consisting of, consisting essentially of, or comprising the amino acid sequences of the KCAT peptides and proteins disclosed in Table 1, (encoded by the nucleic acid molecule shown in Table 1), as well as all obvious variants of these peptides that are within the art to make and use. Some of these variants are described in detail below.

In one embodiment KCAT peptides include, but are not limited to, the amino acid sequence of SEQ ID NOS: 5165-6044 and variants thereof. A KCAT protein includes, but is not limited to, the amino acid sequences of SEQ ID NOS: 1-2736 and variants thereof. KCAT proteins may be differentially expressed in kidney cell line, blood, tissue, serum or body fluids.

The peptide or protein or fragment thereof, to which the invention pertains, however, are not to be construed as encompassing peptide, protein or fragment that may be disclosed publicly prior to the present invention.

The KCAT proteins and peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule is discussed below).

As used herein, a "peptide" is defined as amino acid sequences between 5-20 amino acids derived from KCAT proteins such as SEQ ID NOS: 1-2736 or variants thereof. The peptide differentially expressed in either kidney diseases cell line, blood, tissue, serum or body fluids. In one embodiment peptides include, but are not limited to, the amino acid sequence of SEQ ID NOS: 5165-6044, or variants thereof.

As used herein, a "protein" is full-length protein differentially expressed in kidney diseases cell line, tissue, blood, serum or body fluids. A protein includes, but is not limited to, the amino acid sequences of SEQ ID NOS: 1-2736.

A peptide is said to be "isolated" or "purified" when it is substantially free of cellular material or free of chemical precursors or other chemicals. The peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule are discussed below).

In some uses, "substantially free of cellular material" includes preparations of the peptide having less than about 30% (by dry weight) other proteins (i.e., contaminating protein), less than about 20% other proteins, less than about 10% other proteins, or less than about 5% other proteins. When the peptide is recombinantly produced, it can also be substantially free of culture medium, i.e., culture medium represents less than about 20% of the volume of the protein preparation.

The language "substantially free of chemical precursors or other chemicals" includes preparations of the peptide in which it is separated from chemical precursors or other chemicals that are involved in its synthesis. In one embodiment, the language "substantially free of chemical precursors or other chemicals" includes preparations of the KCAT peptide having less than about 30% (by dry weight) chemical precursors or other chemicals, less than about 20% chemical precursors or other chemicals, less than about 10% chemical precursors or other chemicals, or less than about 5% chemical precursors or other chemicals.

The isolated KCAT proteins and peptide can be purified from cells that naturally express it, purified from cells that have been altered to express it (recombinant), or synthesized using known protein synthesis methods. Sambrook et al., Molecular Cloning: A Laboratory Manual. 3rd. ed., Cold Spring Harbor Laboratory Press, Cold Spring Harbor, N.Y., (2001). Experimental data as provided in Table 1 indicates expression in human kidney cell lines and/or kidney tumor tissues. For example, a nucleic acid molecule encoding the KCAT protein or peptide is cloned into an expression vector, the expression vector introduced into a host cell and the protein expressed in the host cell. The protein or peptide can then be isolated from the cells by an appropriate purification scheme using standard protein purification techniques. Many of these techniques are described in detail below.

A KCAT peptide or protein can be attached to heterologous sequences to form chimeric or fusion proteins. Such Schimeric and fusion proteins comprise a peptide operatively linked to a heterologous protein having an amino acid sequence not substantially homologous to the peptide. "Operatively linked" indicates that the peptide and the heterologous protein are fused in-frame. The heterologous protein can be fused to the N-terminus or C-terminus of the peptide.

In some uses, the fusion protein does not affect the activity of the peptide or protein per se. For example, the fusion protein can include, but is not limited to, fusion proteins, for example beta-galactosidase fusions, yeast two-hybrid GAL fusions, poly-His fusions, MYC-tagged, HI-tagged and Ig fusions. Such fusion proteins, particularly poly-His fusions, can facilitate the purification of recombinant KCAT proteins or peptides. In certain host cells (e.g., mammalian host cells), expression and/or secretion of a protein can be increased by using a heterologous signal sequence.

A chimeric or fusion KCAT protein or peptide can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., Current Protocols in Molecular Biology, 1992). Moreover, many expression vectors are commercially available that already encode a fusion moiety (e.g., a GST protein). A KCAT-encoding nucleic acid can be cloned into such an expression vector such that the fusion moiety is linked in-frame to the KCAT protein or peptide.

As mentioned above, the KCAT peptide or the KCAT protein has obvious variants of the amino acid sequence, such as naturally occurring mature forms of the KCAT, allelic/sequence variants of the KCAT, non-naturally occurring recombinantly derived variants of the KCATs, and orthologs and paralogs of the KCAT proteins or peptides. Such variants can readily be generated using art-known techniques in the fields of recombinant nucleic acid technology and protein biochemistry.

It is understood, however, that KCAT and variants exclude any amino acid sequences disclosed prior to the invention.

Such variants can readily be identified/made using molecular techniques and the sequence information disclosed herein. Further, such variants can readily be distinguished from other peptides based on sequence and/or structural homology to the KCAT peptides of the present invention. The degree of homology/identity present will be based primarily on whether the peptide is a functional variant or non-functional variant, the amount of divergence present in the paralog family and the evolutionary distance between the orthologs.

To determine the percent identity of two amino acid sequences or two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity and similarity between two sequences can be accomplished using a mathematical algorithm. (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). In a preferred embodiment, the percent identity between two amino acid sequences is determined using the Needleman and Wunsch (J. Mol. Biol. (48): 444-453 (1970)) algorithm which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (Devereux, J., et al., Nucleic Acids Res. 12(1):387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12 and a gap penalty of 4.

The nucleic acid and protein sequences of the present invention can further be used as a "query sequence" to perform a search against sequence databases to, for example, identify other family members or related sequences. Such searches can be performed using the NBLAST and XBLAST programs (version 2.0) of Altschul, et al. (J. Mol. Biol. 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (Nucleic Acids Res. 25(17):3389-3402 (1997)). When utilizing BLAST and gapped BLAST programs, the default parameters of the respective programs (e.g., XBLAST and NBLAST) can be used.

Full-length pre-processed forms, as well as mature processed forms, of proteins that comprise one of the peptides of the present invention can readily be identified as having complete sequence identity to one of the KCAT peptides of the present invention as well as being encoded by the same genetic locus as the KCAT peptide provided herein (see Table 1).

Allelic variants of a KCAT peptide can readily be identified as being a human protein having a high degree (significant) of sequence homology/identity to at least a portion of the KCAT peptide as well as being encoded by the same genetic locus as the KCAT peptide provided herein. Genetic locus can readily be determined based on the genomic information provided in Table 1, such as the genomic sequence mapped to the reference human. As used herein, two proteins (or a region of the proteins) have significant homology when the amino acid sequences are typically at least about 70-80%, 80-90%, and more typically at least about 90-95% or more homologous. A significantly homologous amino acid sequence, according to the present invention, will be encoded by a nucleic acid sequence that will hybridize to a KCAT peptide encoding nucleic acid molecule under stringent conditions as more fully described below.

Paralogs of a KCAT peptide can readily be identified as having some degree of significant sequence homology/identity to at least a portion of the KCAT peptide, as being encoded by a gene from humans, and as having similar activity or function. Two proteins will typically be considered paralogs when the amino acid sequences are typically at least about 60% or greater, and more typically at least about 70% or greater homology through a given region or domain. Such paralogs will be encoded by a nucleic acid sequence that will hybridize to a KCAT peptide encoding nucleic acid molecule under moderate to stringent conditions as more fully described below.

Orthologs of a KCAT peptide can readily be identified as having some degree of significant sequence homology/identity to at least a portion of the KCAT peptide as well as being encoded by a gene from another organism. Preferred orthologs will be isolated from mammals, preferably primates, for the development of human therapeutic targets and agents. Such orthologs will be encoded by a nucleic acid sequence that will hybridize to a KCAT peptide encoding nucleic acid molecule under moderate to stringent conditions, as more fully described below, depending on the degree of relatedness of the two organisms yielding the proteins.

Non-naturally occurring variants of the KCAT peptides of the present invention can readily be generated using recombinant techniques. Such variants include, but are not limited to deletions, additions and substitutions in the amino acid sequence of the KCAT peptide. For example, one class of substitutions is conserved amino acid substitution. Such substitutions are those that substitute a given amino acid in a KCAT peptide by another amino acid of like characteristics. Typically seen as conservative substitutions are the replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., Science 247:1306-1310 (1990).

Variant KCAT peptides can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions.

Non-functional variants typically contain one or more non-conservative amino acid substitutions, deletions, insertions, inversions, or truncation or a substitution, insertion, inversion, or deletion in a critical residue or critical region.

Amino acids that are essential for function can be identified by methods known in the art, such as site-directed mutagenesis or alanine-scanning mutagenesis (Cunningham et al., Science 244:1081-1085 (1989)). The latter procedure introduces single alanine mutations at every residue in the molecule. The resulting mutant molecules are then tested for biological activity such as KCAT activity or in assays such as an in vitro proliferative activity. Sites that are critical for binding partner/substrate binding can also be determined by structural analysis such as crystallization, nuclear magnetic resonance or photoaffinity labeling (Smith et al., J. Mol. Biol. 224:899-904 (1992); de Vos et al. Science 255:306-312 (1992)).

The present invention further provides fragments of the KCATs, in addition to proteins and peptides that comprise and consist of such fragments, particularly those comprising the residues identified in Table 1. As used herein, a fragment comprises at least 8, 10, 12, 14, 16, 18, 20 or more contiguous amino acid residues from a KCAT. Such fragments can be chosen based on the ability to retain one or more of the biological activities of the KCAT or could be chosen for the ability to perform a function, e.g. bind a substrate or act as an immunogen. Particularly important fragments are biologically active fragments, peptides that are, for example, about 8 or more amino acids in length. Such fragments will typically comprise a domain or motif of the KCAT, e.g., active site, a transmembrane domain or a substrate-binding domain. Further, possible fragments include, but are not limited to, domain or motif containing fragments, soluble peptide fragments, and fragments containing immunogenic structures. Predicted domains and functional sites are readily identifiable by computer programs well known and readily available to those of skill in the art (e.g., PROSITE analysis).

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in KCATs are described in basic texts, detailed monographs, and the research literature, and they are well known to those of skill in the art.

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as Proteins—Structure and Molecular Properties, 2nd Ed., T. E. Creighton, W.H. Freeman and Company, New York (1993). Many detailed reviews are available on this subject, such as by Wold, F., Posttranslational Covalent Modification of Proteins, B. C. Johnson, Ed., Academic Press, New York 1-2736 (1983); Seifter et al. (Meth. Enzymol. 182: 626-646 (1990)) and Rattan et al. (Ann. N.Y. Acad. Sci. 663:48-62 (1992)).

Accordingly, the KCATs of the present invention also encompass derivatives or analogs in which a substituted amino acid residue is not one encoded by the genetic code, in which a substituent group is included, in which the mature KCAT is fused with another compound, such as a compound to increase the half-life of the KCAT (for example, polyethylene glycol), or in which the additional amino acids are fused to the mature KCAT, such as a leader or secretory sequence or a sequence for purification of the mature KCAT or a proprotein sequence.

Protein/Peptide Uses

The proteins of the present invention can be used in substantial and specific assays related to the functional information provided in Table 1; to raise antibodies or to elicit another immune response; as a reagent (including the labeled reagent) in assays designed to quantitatively determine levels of the protein (or its binding partner or ligand) in biological fluids; and as markers for tissues in which the corresponding protein is preferentially expressed (either constitutively or at a particular stage of tissue differentiation or development or in a disease state). Where the protein binds or potentially binds to another protein or ligand (such as, for example, in a KCAT-effector protein interaction or KCAT-ligand interaction), the protein can be used to identify the binding partner/ligand so as to develop a system to identify inhibitors of the binding interaction. Any or all of these uses are capable of being developed into reagent grade or kit format for commercialization as commercial products.

Methods for performing the uses listed above are well known to those skilled in the art. References disclosing such methods include "Molecular Cloning: A Laboratory Manual", Sambrook, J., E. F. Fritsch and T. Maniatis eds., 3rd. ed., Cold Spring Harbor Laboratory Press, Cold Spring Harbor, N.Y., (2001), and "Methods in Enzymology: Guide to Molecular Cloning Techniques", Academic Press, Berger, S. L. and A. R. Kimmel eds., 1987.

The potential uses of the peptides of the present invention are based primarily on the source of the protein as well as the class/action of the protein. For example, KCATs isolated from humans and their human/mammalian orthologs serve as targets for identifying agents for use in mammalian therapeutic applications, e.g. a human drug, particularly in modulating a biological or pathological response in a cell or tissue that expresses the KCAT. Experimental data as provided in Table 1 indicate that the KCATs of the present invention are expressed at differential level in various kidney cell lines and/or kidney tissues, for example, SEQ ID NOS: 1-2736.

A large percentage of pharmaceutical agents are being developed that modulate the activity of KCAT proteins, particularly members of the KCAT subfamily (see Background of the Invention). The structural and functional information provided in the Background and Table 1 provide specific and substantial uses for the molecules of the present invention, particularly in combination with the expression information provided in Table 1. Experimental data as provided in Table 1 indicates expression in human kidney cell lines and/or kidney tumor tissues. Such uses can readily be determined using the information provided herein, that which is known in the art, and routine experimentation.

The proteins of the present invention (including variants and fragments that may have been disclosed prior to the present invention) are useful for biological assays related to KCATs that are related to members of the KCAT subfamily. Such assays involve any of the known KCAT functions or activities or properties useful for diagnosis and treatment of KCAT-related conditions that are specific for the subfamily of KCATs that the one of the present invention belongs to, particularly in cells and tissues that express the KCAT. Experimental data as provided in Table 1 indicate that the KCATs of the present invention are expressed at differential level in various kidney cell lines and/or kidney tissues, for example, SEQ ID NOS: 1-2736.

The proteins of the present invention are also useful in drug screening assays, in cell-based or cell-free systems. Cell-based systems can be native, i.e., cells that normally express the KCAT, as a biopsy or expanded in cell culture. Experimental data as provided in Table 1 indicates expression in human kidney cell lines and/or kidney tumor tissues. In an alternate embodiment, cell-based assays involve recombinant host cells expressing the KCAT protein.

The polypeptides can be used to identify compounds or agents that modulate KCAT activity of the protein in its natural state or an altered form that causes a specific disease or pathology associated with the KCAT. Both the KCATs of the present invention and appropriate variants and fragments can be used in high-throughput screens to assay candidate compounds for the ability to bind to the KCAT. These compounds can be further screened against a functional KCAT to determine the effect of the compound on the KCAT activity. Further, these compounds can be tested in animal or invertebrate systems to determine activity/effectiveness. Compounds can be identified that activate (agonist) or inactivate (antagonist) the KCAT to a desired degree.

Further, the proteins of the present invention can be used to screen a compound or an agent for the ability to stimulate or inhibit interaction between the KCAT protein and a molecule that normally interacts with the KCAT protein, e.g. a substrate or an extracellular binding ligand or a component of the signal pathway that the KCAT protein normally interacts (for example, a cytosolic signal protein or another KCAT). Such assays typically include the steps of combining the KCAT protein with a candidate compound under conditions that allow the KCAT protein, or fragment, to interact with the target molecule, and to detect the formation of a complex between the protein and the target or to detect the biochemical consequence of the interaction with the KCAT protein and the target, such as any of the associated effects of signal transduction such as protein phosphorylation, cAMP turnover, and adenylate cyclase activation, etc. Candidate compounds or agents include, for example, 1) peptides such as soluble peptides, including Ig-tailed fusion peptides and members of random peptide libraries (see, e.g., Lam et al., Nature 354: 82-84 (1991); Houghten et al., Nature 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')2, Fab expression library fragments, and epitope-binding fragments of antibodies); and 4) small organic and inorganic molecules (e.g., molecules obtained from combinatorial and natural product libraries).

One candidate compound or agent is a soluble fragment of the KCAT that competes for substrate binding. Other candidate compounds include mutant KCATs or appropriate fragments containing mutations that affect KCAT function and thus compete for substrate. Accordingly, a fragment that competes for substrate, for example with a higher affinity, or a fragment that binds substrate but does not allow release, is encompassed by the invention.

The invention further includes other end point assays to identify compounds that modulate (stimulate or inhibit) KCAT activity. The assays typically involve an assay of events in the signal transduction pathway that indicate KCAT activity. Thus, the phosphorylation of a substrate, activation of a protein, a change in the expression of genes that are up- or down-regulated in response to the KCAT protein dependent signal cascade can be assayed. Any of the biological or biochemical functions mediated by the KCAT can be used as an endpoint assay. These include all of the biochemical or biochemical/biological events described herein, in the references cited herein, incorporated by reference for these endpoint assay targets, and other functions known to those of ordinary skill in the art or that can be readily identified using the information provided in Table 1. Specifically, a biological function of a cell or tissues that expresses the KCAT can be assayed. Experimental data as provided in Table 1 indicate that the KCATs of the present invention are expressed at differential level in various kidney cell lines and/or kidney tissues, for example, SEQ ID NOS: 1-2736.

Binding and/or activating compounds can also be screened by using chimeric KCAT proteins in which the amino terminal extracellular domain, or parts thereof, the entire transmembrane domain or subregions, such as any of the seven transmembrane segments or any of the intracellular or extracellular loops and the carboxy terminal intracellular domain, or parts thereof, can be replaced by heterologous domains or subregions. For example, a substrate-binding region can be used that interacts with a different substrate then that which is recognized by the native KCAT. Accordingly, a different set of signal transduction components is available as an end-point assay for activation. This allows for assays to be performed in other than the specific host cell from which the KCAT is derived.

The proteins of the present invention are also useful in competition binding assays in methods designed to discover compounds that interact with the KCAT (e.g. binding partners and/or ligands). Thus, a compound is exposed to a KCAT polypeptide under conditions that allow the compound to bind or to otherwise interact with the polypeptide. Soluble KCAT polypeptide is also added to the mixture. If the test compound interacts with the soluble KCAT polypeptide, it decreases the amount of complex formed or activity from the KCAT. This type of assay is particularly useful in cases in which compounds are sought that interact with specific regions of the KCAT. Thus, the soluble polypeptide that competes with the target KCAT region is designed to contain peptide sequences corresponding to the region of interest. To perform cell free drug screening assays, it is sometimes desirable to immobilize either the KCAT protein, or fragment, or its target molecule to facilitate separation of complexes from uncomplexed forms of one or both of the proteins, as well as to accommodate automation of the assay.

Techniques for immobilizing proteins on matrices can be used in the drug screening assays. In one embodiment, a fusion protein can be provided which adds a domain that allows the protein to be bound to a matrix. For example, glutathione-S-transferase fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and the candidate compound, and the mixture incubated under conditions conducive to complex formation (e.g., at physiological conditions for salt and pH). Following incubation, the beads are washed to remove any unbound label, and the matrix immobilized and radiolabel determined directly, or in the supernatant after the complexes are dissociated. Alternatively, the complexes can be dissociated from the matrix, separated by SDS-PAGE, and the level of KCAT-binding protein found in the bead fraction quantitated from the gel using standard electrophoretic techniques. For example, either the polypeptide or its target molecule can be immobilized utilizing conjugation of biotin and streptavidin using techniques well known in the art. Alternatively, antibodies reactive with the protein but which do not interfere with binding of the protein to its target molecule can be derivatized to the wells of the plate, and the protein trapped in the wells by antibody conjugation. Preparations of a KCAT-binding protein and a candidate compound are incubated in the KCAT protein-presenting wells and the amount of complex trapped in the well can be quantitated. Methods for detecting such complexes, in addition to those described above for the GST-immobilized complexes, include immunodetection of complexes using antibodies reactive with the KCAT protein target molecule, or which are reactive with KCAT protein and compete with the target molecule, as well as KCAT-linked assays which rely on detecting an enzymatic activity associated with the target molecule.

Agents that modulate one of the KCATs of the present invention can be identified using one or more of the above assays, alone or in combination. It is generally preferable to use a cell-based or cell free system first and then confirm activity in an animal or other model system. Such model systems are well known in the art and can readily be employed in this context.

Modulators of KCAT protein activity identified according to these drug screening assays can be used to treat a subject with a disorder mediated by the KCAT pathway, by treating cells or tissues that express the KCAT. Experimental data as provided in Table 1 indicates expression in human kidney cell lines and/or kidney tumor tissues. These methods of treatment include the steps of administering a modulator of KCAT activity in a pharmaceutical composition to a subject in need of such treatment, the modulator being identified as described herein.

In yet another aspect of the invention, the KCAT proteins can be used as "bait proteins" in a two-hybrid assay or three-hybrid assay (see, e.g., U.S. Pat. No. 5,283,317; Zervos et al. (1993) Cell 72:223-232; Madura et al. (1993) J. Biol. Chem. 268:12046-12054; Bartel et al. (1993) Biotechniques 14:920-924; Iwabuchi et al. (1993) Oncogene 8:1693-1696; and Brent WO94/10300), to identify other proteins, which bind to or interact with the KCAT and are involved in KCAT activity. Such KCAT-binding proteins are also likely to be involved in the propagation of signals by the KCAT proteins or KCAT targets as, for example, downstream elements of a KCAT-mediated signaling pathway. Alternatively, such KCAT-binding proteins are likely to be KCAT inhibitors.

The two-hybrid system is based on the modular nature of most transcription factors, which consist of separable DNA-binding and activation domains. Briefly, the assay utilizes two different DNA constructs. In one construct, the gene that codes for a KCAT protein is fused to a gene encoding the DNA binding domain of a known transcription factor (e.g., GAL-4). In the other construct, a DNA sequence, from a library of DNA sequences that encode an unidentified protein ("prey" or "sample") is fused to a gene that codes for the activation domain of the known transcription factor. If the "bait" and the "prey" proteins are able to interact, in vivo, forming a KCAT-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the KCAT protein.

This invention further pertains to novel agents identified by the above-described screening assays. Accordingly, it is within the scope of this invention to further use an agent identified as described herein in an appropriate animal model. For example, an agent identified as described herein (e.g., a KCAT-modulating agent, an antisense KCAT nucleic acid molecule, an KCAT-RNAi fragment, a KCAT-specific antibody, or a KCAT-binding partner) can be used in an animal or other model to determine the efficacy, toxicity, or side effects of treatment with such an agent. Alternatively, an agent identified as described herein can be used in an animal or other model to determine the mechanism of action of such an agent. Furthermore, this invention pertains to uses of novel agents identified by the above-described screening assays for treatments as described herein.

The KCAT proteins of the present invention are also useful to provide a target for diagnosing a disease or predisposition to disease mediated by the peptide. Accordingly, the invention provides methods for detecting the presence, or levels of, the protein (or encoding mRNA) in a cell, tissue, or organism. Experimental data as provided in Table 1 indicates expression in human kidney cell lines and/or kidney tumor tissues. The method involves contacting a biological sample with a compound capable of interacting with the KCAT protein such that the interaction can be detected. Such an assay can be provided in a single detection format or a multi-detection format such as an antibody chip array.

One agent for detecting a protein in a sample is an antibody capable of selectively binding to protein. A biological sample includes tissues, cells and biological fluids isolated from a subject, as well as tissues, cells and fluids present within a subject.

The peptides of the present invention also provide targets for diagnosing active protein activity, disease, or predisposition to disease, in a patient having a variant peptide, particularly activities and conditions that are known for other members of the family of proteins to which the present one belongs. Thus, the peptide can be isolated from a biological sample and assayed for the presence of a genetic mutation that results in aberrant peptide. This includes amino acid substitution, deletion, insertion, rearrangement, (as the result of aberrant splicing events), and inappropriate post-translational modification. Analytic methods include altered electrophoretic mobility, altered tryptic peptide digest, altered KCAT activity in cell-based or cell-free assay, alteration in substrate or antibody-binding pattern, altered isoelectric point, direct amino acid sequencing, and any other of the known assay techniques useful for detecting mutations in a protein. Such an assay can be provided in a single detection format or a multi-detection format such as an antibody chip array.

In vitro techniques for detection of peptide include enzyme linked immunosorbent assays (ELISAs), Western blots, immunoprecipitations and immunofluorescence using a detection reagent, such as an antibody or protein binding agent. Alternatively, the peptide can be detected in vivo in a subject by introducing into the subject a labeled anti-peptide antibody or other types of detection agent. For example, the antibody can be labeled with a radioactive marker whose presence and location in a subject can be detected by standard imaging techniques. Particularly useful are methods that detect the allelic variant of a peptide expressed in a subject and methods which detect fragments of a peptide in a sample.

The peptides are also useful in pharmacogenomic analysis. Pharmacogenomics deal with clinically significant hereditary variations in the response to drugs due to altered drug disposition and abnormal action in affected persons. See, e.g., Eichelbaum, M. (Clin. Exp. Pharmacol. Physiol. 23(10-11): 983-985 (1996)), and Linder, M. W. (Clin. Chem. 43(2):254-266 (1997)). The clinical outcomes of these variations result in severe toxicity of therapeutic drugs in certain individuals or therapeutic failure of drugs in certain individuals as a result of individual variation in metabolism. Thus, the genotype of the individual can determine the way a therapeutic compound acts on the body or the way the body metabolizes the compound. Further, the activity of drug metabolizing enzymes affects both the intensity and duration of drug action. Thus, the pharmacogenomics of the individual permit the selection of effective compounds and effective dosages of such compounds for prophylactic or therapeutic treatment based on the individual's genotype. The discovery of genetic polymorphisms in some drug metabolizing enzymes has explained why some patients do not obtain the expected drug effects, show an exaggerated drug effect, or experience serious toxicity from standard drug dosages. Polymorphisms can be expressed in the phenotype of the extensive metabolizer and the phenotype of the poor metabolizer. Accordingly, genetic polymorphism may lead to allelic protein variants of the KCAT protein in which one or more of the KCAT functions in one population are different from those in another population. The peptides thus allow a target to ascertain a genetic predisposition that can affect treatment modality. Thus, in a ligand-based treatment, polymorphism may give rise to amino terminal extracellular domains and/or other substrate-binding regions that are more or less active in substrate binding, and KCAT activation. Accordingly, substrate dosage would necessarily be modified to maximize the therapeutic effect within a given population containing a polymorphism. As an alternative to genotyping, specific polymorphic peptides could be identified.

The peptides are also useful for treating a disorder characterized by an absence of, inappropriate, or unwanted expression of the protein. Experimental data as provided in Table 1 indicates expression in human kidney cell lines and/or kidney tumor tissues. Accordingly, methods for treatment include the use of the KCAT protein or fragments.

Antibodies

The present invention provides antibodies specifically bind to KCAT proteins or fragments thereof, peptides, or antigenic portion thereof.

The invention also provides antibodies that selectively bind to one of the peptides of the present invention, a protein comprising such a peptide, as well as variants and fragments thereof as describe above.

The antibody of present invention selectively binds a target KCAT when it binds the target domain and does not significantly bind to unrelated proteins. An antibody is still considered to selectively bind a peptide even if it also binds to other proteins that are not substantially homologous with the target peptide so long as such proteins share homology with a fragment or domain of the peptide target of the antibody. In this case, it would be understood that antibody binding to the peptide is still selective despite some degree of cross-reactivity.

The term "antibody" is used in the broadest sense, and specifically covers monoclonal antibodies (including full length monoclonal antibodies), polyclonal antibodies, multi-specific antibodies (e.g., bispecific antibodies), humanized antibody and antibody fragments (e.g., Fab, F(ab').sub.2 and Fv) so long as they exhibit the desired biological activity. Antibodies (Abs) and immunoglobulins (Igs) are glycoproteins having the same structural characteristics. While antibodies exhibit binding specificity to a specific antigen, immunoglobulins include both antibodies and other antibody-like molecules that lack antigen specificity.

As used herein, antibodies are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end. The constant domain of the light chain is aligned with the first constant domain of the heavy chain, and the light chain variable domain is aligned with the variable domain of the heavy chain. Particular amino acid residues are believed to form an interface between the light and heavy chain variable domains. Chothia et al., J. Mol. Biol. 186, 651-63 (1985); Novotny and Haber, Proc. Natl. Acad. Sci. USA 82 4592-4596 (1985).

An "isolated" antibody is one which has been identified and separated and/or recovered from a component of the environment in which is produced. Contaminant components of its production environment are materials that would interfere with diagnostic or therapeutic uses for the antibody, and may include enzymes, hormones, and other proteinaceous or nonproteinaceous solutes. In preferred embodiments, the antibody will be purified as measurable by at least three different methods: 1) to greater than 95% by weight of antibody as determined by the Lowry method, and most preferably more than 99% by weight; 2) to a degree sufficient to obtain at least 15 residues of N-terminal or internal amino acid sequence by use of a spinning cup sequentator; or 3) to homogeneity by SDS-PAGE under reducing or non-reducing conditions using Coomasie blue or, preferably, silver stain. Isolated antibody includes the antibody in situ within recombinant cells since at least one component of the antibody's natural environment will not be present. Ordinarily, however, isolated antibody will be prepared by at least one purification step.

An "antigenic region" or "antigenic determinant" or an "epitope" includes any protein determinant capable of specific binding to an antibody. This is the site on an antigen to which each distinct antibody molecule binds. Epitopic determinants usually consist of active surface groupings of molecules such as amino acids or sugar side chains and usually have specific three-dimensional structural characteristics, as well as charge characteristics.

"Antibody specificity," is an antibody, which has a stronger binding affinity for an antigen from a first subject species than it has for a homologue of that antigen from a second subject species. Normally, the antibody "bind specifically" to a human antigen (i.e., has a binding affinity (Kd) value of no more than about $1 \times 10^{-7}$ M, preferably no more than about $1 \times 10^{-8}$ and most preferably no more than about $1 \times 10^{-9}$ M) but has a binding affinity for a homologue of the antigen from a second subject species which is at least about 50 fold, or at least about 500 fold, or at least about 1000 fold, weaker than its binding affinity for the human antigen. The antibody can be of any of the various types of antibodies as defined above, but preferably is a humanized or human antibody (Queen et al., U.S. Pat. Nos. 5,530,101, 5,585,089; 5,693,762; and 6,180,370).

The present invention provides an "antibody variant," which refers to an amino acid sequence variant of an antibody wherein one or more of the amino acid residues have been modified. Such variant necessarily have less than 100% sequence identity or similarity with the amino acid sequence having at least 75% amino acid sequence identity or similarity with the amino acid sequence of either the heavy or light chain variable domain of the antibody, more preferably at least 80%, more preferably at least 85%, more preferably at least 90%, and most preferably at least 95%. Since the method of the invention applies equally to both polypeptides, antibodies and fragments thereof, these terms are sometimes employed interchangeably.

The term "variable" in the context of variable domain of antibodies refers to the fact that certain portions of the variable domains differ extensively in sequence among antibodies and are used in the binding and specificity of each particular antibody for its particular antigen. However, the variability is not evenly distributed through the variable domains of antibodies. It is concentrated in three segments called complementarity determining regions (CDRs) also known as hypervariable regions both in the light chain and the heavy chain variable domains. There are at least two techniques for determining CDRs: (1) an approach based on cross-species sequence variability (i.e., Kabat et al., Sequences of Proteins of Immunological Interest (National Institute of Health, Bethesda, Md. 1987); and (2) an approach based on crystallographic studies of antigen-antibody complexes (Chothia, C. et al. (1989), Nature 342: 877). The more highly conserved portions of variable domains are called the framework (FR). The variable domains of native heavy and light chains each comprise four FR regions, largely adopting a beta.-Sheet configuration, connected by three CDRs, which form loops connecting, and in some cases forming part of, the .beta.-sheet structure. The CDRs in each chain are held together in close proximity by the FR regions and, with the CDRs from the other chain, contribute to the formation of the antigen-binding site of antibodies (see Kabat et al.) The constant domains are not involved directly in binding an antibody to an antigen, but exhibit various effector functions, such as participation of the antibody in antibody-dependent cellular toxicity.

The term "antibody fragment" refers to a portion of a full-length antibody, generally the antigen binding or variable region. Examples of antibody fragments include Fab, Fab', $F(ab')_2$ and Fv fragments. Papain digestion of antibodies produces two identical antigen binding fragments, called the Fab fragment, each with a single antigen binding site, and a residual "Fc" fragment, so-called for its ability to crystallize readily. Pepsin treatment yields an $F(ab')_2$ fragment that has two antigen binding fragments which are capable of crosslinking antigen, and a residual other fragment (which is termed pFc'). Additional fragments can include diabodies, linear antibodies, single-chain antibody molecules, and multispecific antibodies formed from antibody fragments. As used herein, "functional fragment" with respect to antibodies, refers to Fv, F(ab) and $F(ab')_2$ fragments.

An "Fv" fragment is the minimum antibody fragment that contains a complete antigen recognition and binding site. This region consists of a dimer of one heavy and one light chain variable domain in a tight, non-covalent association ($V_H$-$V_L$ dimer). It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment [also designated as F(ab)] also contains the constant domain of the light chain and the first constant domain (CH1) of the heavy chain. Fab' fragments differ from Fab fragments by the addition of a few residues at the carboxyl terminus of the heavy chain CH1 domain including one or more cysteines from the antibody hinge region. Fab'-SH is the designation herein for Fab' in which the cysteine residue(s) of the constant domains have a free thiol group. F(ab') fragments are produced by cleavage of the disulfide bond at the hinge cysteines of the $F(ab')_2$ pepsin digestion product. Additional chemical couplings of antibody fragments are known to those of ordinary skill in the art.

The present invention further provides monoclonal antibody, polyclonal antibody as well as humanized antibody. In general, to generate antibodies, an isolated peptide is used as an immunogen and is administered to a mammalian organism, such as a rat, rabbit or mouse. The full-length protein, an antigenic peptide fragment or a fusion protein of the KCAT protein can be used. Particularly important fragments are those covering functional domains, some but not all the examples of the domains are identified in Table 1. Many methods are known for generating and/or identifying antibodies to a given target peptide. Several such methods are described by Harlow, Antibodies, Cold Spring Harbor Press, (1989).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In additional to their specificity, the monoclonal antibodies are advantageous in that they are synthesized by the hybridoma culture, uncontaminated by other immunoglobulins. The modifier "monoclonal" antibody indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, Nature 256, 495 (1975), or may be made by recombinant methods, e.g., as described in U.S. Pat. No. 4,816,567. The monoclonal antibodies for use with the present invention may also be isolated from phage antibody libraries using the techniques described in Clackson et al. Nature 352: 624-628 (1991), as well as in Marks et al., J. Mol. Biol. 222: 581-597 (1991). For detailed procedure for making a monoclonal antibody, see the Example below.

"Humanized" forms of non-human (e.g. murine or rabbit) antibodies are chimeric immunoglobulins, immunoglobulin chains or fragments thereof (such as Fv, Fab, Fab', F(ab').sub.2 or other antigen-binding subsequences of antibodies) which contain minimal sequence derived from non-human immunoglobulin. For the most part, humanized antibodies are human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Furthermore, humanized antibody may comprise residues, which are found neither in the recipient antibody nor in the imported CDR or framework sequences. These modifications are made to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin. For further details, see: Jones et al., Nature 321, 522-525 (1986); Reichmann et al., Nature 332, 323-327 (1988) and Presta, Curr. Op. Struct. Biol. 2, 593-596 (1992).

Polyclonal antibodies may be prepared by any known method or modifications of these methods including obtaining antibodies from patients. For example, a complex of an immunogen such as KCAT protein, peptides or fragments thereof and a carrier protein is prepared and an animal is immunized by the complex according to the same manner as that described with respect to the above monoclonal antibody preparation and the description in the Example. A serum or plasma containing the antibody against the protein is recovered from the immunized animal and the antibody is separated and purified. The gamma globulin fraction or the IgG antibodies can be obtained, for example, by use of saturated ammonium sulfate or DEAE Sephadex, or other techniques known to those skilled in the art.

The antibody titer in the antiserum can be measured according to the same manner as that described above with respect to the supernatant of the hybridoma culture. Separation and purification of the antibody can be carried out according to the same separation and purification method of antibody as that described with respect to the above monoclonal antibody and in the Example.

The protein used here in as the immunogen is not limited to any particular type of immunogen. In one aspect, antibodies are preferably prepared from regions or discrete fragments of the KCAT proteins. Antibodies can be prepared from any region of the peptide as described herein. In particular, they are selected from a group consisting of SEQ ID NOS: 5165-6044 and fragments of SEQ ID NOS: 1-2736. An antigenic fragment will typically comprise at least 8 contiguous amino acid residues. The antigenic peptide can comprise, however, at least 10, 12, 14, 16 or more amino acid residues. Such fragments can be selected on a physical property, such as fragments correspond to regions that are located on the surface of the protein, e.g., hydrophilic regions or can be selected based on sequence uniqueness.

Antibodies may also be produced by inducing production in the lymphocyte population or by screening antibody libraries or panels of highly specific binding reagents as disclosed in Orlandi et al. (1989; Proc Natl Acad Sci 86:3833-3837) or Winter et al. (1991; Nature 349:293-299). A protein may be used in screening assays of phagemid or B-lymphocyte immunoglobulin libraries to identify antibodies having a desired specificity. Numerous protocols for competitive binding or immunoassays using either polyclonal or monoclonal antibodies with established specificities are well known in the art. Smith G. P., 1991, Curr. Opin. Biotechnol. 2: 668-673.

The antibodies of the present invention can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

Antibody can be also made recombinantly. When using recombinant techniques, the antibody variant can be produced intracellularly, in the periplasmic space, or directly secreted into the medium. If the antibody variant is produced intracellularly, as a first step, the particulate debris, either host cells or lysed fragments, is removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 minutes. Cell debris can be removed by centrifugation. Where the antibody variant is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibodies or antigen binding fragments may also be produced by genetic engineering. The technology for expression of both heavy and light cain genes in *E. coli* is the subject the following PCT patent applications; publication number WO 901443, WO901443, and WO 9014424 and in Huse et al., 1989 Science 246:1275-1281. The general recombinant methods are well known in the art.

The antibody composition prepared from the cells can be purified using, for example, hydroxylapatite chromatography, gel elecrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human delta.1, .delta.2 or .delta.4 heavy chains (Lindmark et al., J. Immunol. Meth. 62: 1-13 (1983)). Protein G is recommended for all mouse isotypes and for human .delta.3 (Guss et al., EMBO J. 5: 1567-1575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH3 domain, the Bakerbond ABXTM resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™. chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5; preferably performed at low salt concentrations (e.g., from about 0-0.25M salt).

Antibody Uses

The antibodies can be used to isolate one of the proteins of the present invention by standard techniques, such as affinity chromatography or immunoprecipitation. The antibodies can facilitate the purification of the natural protein from cells and recombinantly produced protein expressed in host cells. In addition, such antibodies are useful to detect the presence of one of the proteins of the present invention in cells or tissues to determine the pattern of expression of the protein among various tissues in an organism and over the course of normal development. Experimental data as provided in Table 1 indicate that the KCATs of the present invention are expressed at differential level in various kidney cell lines and/or kidney tissues, for example, SEQ ID NOS: 1-2736. Further, such antibodies can be used to detect protein in situ, in vitro, or in a cell lysate or supernatant in order to evaluate the abundance and pattern of expression. Also, such antibodies can be used to assess abnormal tissue distribution or abnormal expression during development or progression of a biological condition. Antibody detection of circulating fragments of the full length protein can be used to identify turnover.

Further, the antibodies can be used to assess expression in disease states such as in active stages of the disease or in an individual with a predisposition toward disease related to the protein's function. When a disorder is caused by an inappropriate tissue distribution, developmental expression, level of expression of the protein, or expressed/processed form, the antibody can be prepared against the normal protein. Experimental data as provided in Table 1 indicates expression in human kidney cell lines and/or kidney tumor tissues. If a disorder is characterized by a specific mutation in the protein, antibodies specific for this mutant protein can be used to assay for the presence of the specific mutant protein.

The antibodies can also be used to assess normal and aberrant subcellular localization of cells in the various tissues in an organism. Experimental data as provided in Table 1 indicates expression in human kidney cell lines and/or kidney tumor tissues. The diagnostic uses can be applied, not only in genetic testing, but also in monitoring a treatment modality. Accordingly, where treatment is ultimately aimed at correcting expression level or the presence of aberrant sequence and aberrant tissue distribution or developmental expression, antibodies directed against the protein or relevant fragments can be used to monitor therapeutic efficacy. More detection and diagnosis methods are described in detail below.

Additionally, antibodies are useful in pharmacogenomic analysis. Thus, antibodies prepared against polymorphic proteins can be used to identify individuals that require modified treatment modalities. The antibodies are also useful as diagnostic tools as an immunological marker for aberrant protein analyzed by electrophoretic mobility, isoelectric point, tryptic peptide digest, and other physical assays known to those in the art.

The antibodies are also useful for tissue typing. Experimental data as provided in Table 1 indicates expression in human kidney cell lines and/or kidney tumor tissues. Thus, where a specific protein has been correlated with expression in a specific tissue, antibodies that are specific for this protein can be used to identify a tissue type.

The antibodies are also useful for inhibiting protein function, for example, blocking the binding of the KCAT peptide to a binding partner such as a substrate. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated with a cell or cell membrane. More therapeutics methods are described in detail below.

The invention also encompasses kits for using antibodies to detect the presence of a protein in a biological sample. The kit can comprise antibodies such as a labeled or labelable antibody and a compound or agent for detecting protein in a biological sample; means for determining the amount of protein in the sample; means for comparing the amount of protein in the sample with a standard; and instructions for use. Such a kit can be supplied to detect a single protein or epitope or can be configured to detect one of a multitude of epitopes, such as Nucleic Acid Molecules The present invention further provides isolated nucleic acid molecules that encode a KCAT peptide or protein of the present invention. Such nucleic acid molecules will consist of, consist essentially of, or comprise a nucleotide sequence that encodes one of the KCAT peptides of the present invention, an allelic variant thereof, or an ortholog or paralog thereof. The nucleic acid molecules and the fragments thereof of the present invention pertains, however, are not to be construed as encompassing fragments that may be disclosed publicly prior to the present invention.

As used herein, an "isolated" nucleic acid molecule is one that is separated from other nucleic acid present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. However, there can be some flanking nucleotide sequences, for example up to about 5 KB, 4 KB, 3 KB, 2 KB, or 1 KB or less, particularly contiguous peptide encoding sequences and peptide encoding sequences within the same gene but separated by introns in the genomic sequence. The important point is that the nucleic acid is isolated from remote and unimportant flanking sequences such that it can be subjected to the specific manipulations described herein such as recombinant expression, preparation of probes and primers, and other uses specific to the nucleic acid sequences.

Moreover, an "isolated" nucleic acid molecule, such as a transcript/cDNA molecule, can be substantially free of other cellular material, or culture medium when produced by recombinant techniques, or chemical precursors or other chemicals when chemically synthesized. However, the nucleic acid molecule can be fused to other coding or regulatory sequences and still be considered isolated.

For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated DNA molecules of the present invention. Isolated nucleic acid molecules according to the present invention further include such molecules produced synthetically.

The present invention further provides nucleic acid molecules that comprise the nucleotide sequences shown in Table 1, (SEQ ID NOS: 2737-5164), or any nucleic acid molecule that encodes the protein provided in Table 1, (SEQ ID NOS: 1-2736). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleic acid residues, such as nucleic acid residues that are naturally associated with it or heterologous nucleotide sequences. Such a nucleic acid molecule can have a few additional nucleotides or can comprise several hundred or more additional nucleotides. A brief description of how various types of these nucleic acid molecules can be readily made/isolated is provided below.

In Table 1, human transcript sequences are provided. As discussed below, some of the non-coding regions, particularly gene regulatory elements such as promoters, are useful for a variety of purposes, e.g. control of heterologous gene expression, target for identifying gene activity modulating compounds, and are particularly claimed as fragments of the genomic sequence provided herein.

The isolated nucleic acid molecules can encode the mature protein plus additional amino or carboxyl-terminal amino acids, or amino acids interior to the mature peptide (when the mature form has more than one peptide chain, for instance). Such sequences may play a role in processing of a protein from precursor to a mature form, facilitate protein trafficking, prolong or shorten protein half-life or facilitate manipulation of a protein for assay or production, among other things. As generally is the case in situ, the additional amino acids may be processed away from the mature protein by cellular enzymes.

As mentioned above, the isolated nucleic acid molecules include, but are not limited to, the sequence encoding the KCAT peptide alone, the sequence encoding the mature peptide and additional coding sequences, such as a leader or secretory sequence (e.g., a pre-pro or pro-protein sequence), the sequence encoding the mature peptide, with or without the additional coding sequences, plus additional non-coding sequences, for example introns and non-coding 5' and 3' sequences such as transcribed but non-translated sequences that play a role in transcription, mRNA processing (including splicing and polyadenylation signals), ribosome binding and stability of mRNA. In addition, the nucleic acid molecule may be fused to a marker sequence encoding, for example, a peptide that facilitates purification.

Isolated nucleic acid molecules can be in the form of RNA, such as mRNA, or in the form DNA, including cDNA and genomic DNA obtained by cloning or produced by chemical synthetic techniques or by a combination thereof. The nucleic acid, especially DNA, can be double-stranded or single-stranded. Single-stranded nucleic acid can be the coding strand (sense strand) or the non-coding strand (anti-sense strand).

The invention further provides nucleic acid molecules that encode fragments of the peptides of the present invention as well as nucleic acid molecules that encode obvious variants of the KCAT proteins of the present invention that are described above. Such nucleic acid molecules may be naturally occurring, such as allelic variants (same locus), paralogs (different locus), and orthologs (different organism), or may be constructed by recombinant DNA methods or by chemical synthesis. Such non-naturally occurring variants may be made by mutagenesis techniques, including those applied to nucleic acid molecules, cells, or organisms. Accordingly, as discussed above, the variants can contain nucleotide substitutions, deletions, inversions and insertions. Variation can occur in either or both the coding and non-coding regions. The variations can produce both conservative and non-conservative amino acid substitutions.

The present invention further provides non-coding fragments of the nucleic acid molecules provided in Table 1. Preferred non-coding fragments include, but are not limited to, promoter sequences, enhancer sequences, gene modulating sequences and gene termination sequences. Such fragments are useful in controlling heterologous gene expression and in developing screens to identify gene-modulating agents. A promoter can readily be identified as being 5' to the ATG start site in the genomic sequence.

A fragment comprises a contiguous nucleotide sequence greater than 12 or more nucleotides. Further, a fragment could at least 30; 40, 50, 100, 250 or 500 nucleotides in length. The length of the fragment will be based on its intended use. For example, the fragment can encode epitope bearing regions of the peptide, or can be useful as DNA probes and primers. Such fragments can be isolated using the known nucleotide sequence to synthesize an oligonucleotide probe. A labeled probe can then be used to screen a cDNA library, genomic DNA library, or mRNA to isolate nucleic acid corresponding to the coding region. Further, primers can be used in PCR reactions to clone specific regions of gene.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides.

Orthologs, homologs, and allelic variants can be identified using methods well known in the art. As described in the Peptide Section, these variants comprise a nucleotide sequence encoding a peptide that is typically 60-70%, 70-80%, 80-90%, and more typically at least about 90-95% or more homologous to the nucleotide sequence shown in Table 1 or a fragment of this sequence. Such nucleic acid molecules can readily be identified as being able to hybridize under moderate to stringent conditions, to the nucleotide sequence shown in the FIGURE sheets or a fragment of the sequence. Allelic variants can readily be determined by genetic locus of the encoding gene.

As used herein, the term "hybridizes under stringent conditions" is intended to describe conditions for hybridization and washing under which nucleotide sequences encoding a peptide at least 60-70% homologous to each other typically remain hybridized to each other. The conditions can be such that sequences at least about 60%, at least about 70%, or at least about 80% or more homologous to each other typically remain hybridized to each other. Such stringent conditions are known to those skilled in the art and can be found in Current Protocols in Molecular Biology, John Wiley & Sons, N.Y. (1989), 6.3.1-6.3.6. One example of stringent hybridization conditions are hybridization in 6× sodium chloride/sodium citrate (SSC) at about 45 C, followed by one or more washes in 0.2×SSC, 0.1% SDS at 50-65 C. Examples of moderate to low stringency hybridization conditions are well known in the art.

Nucleic Acid Molecule Uses

The nucleic acid molecules of the present invention are useful for probes, primers, chemical intermediates, and in biological assays. The nucleic acid molecules are useful as a hybridization probe for messenger RNA, transcript/cDNA and genomic DNA to isolate full-length cDNA and genomic clones encoding the peptide described in Table 1 and to isolate cDNA and genomic clones that correspond to variants (alleles, orthologs, etc.) producing the same or related peptides shown in Table 1.

The probe can correspond to any sequence along the entire length of the nucleic acid molecules provided in Table 1. Accordingly, it could be derived from 5' noncoding regions, the coding region, and 3' noncoding regions. However, as discussed, fragments are not to be construed as encompassing fragments disclosed prior to the present invention.

The nucleic acid molecules are also useful as primers for PCR to amplify any given region of a nucleic acid molecule and are useful to synthesize antisense molecules of desired length and sequence.

The nucleic acid molecules are also useful for constructing recombinant vectors. Such vectors include expression vectors that express a portion of, or all of, the peptide sequences. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced mutations.

The nucleic acid molecules are also useful for expressing antigenic portions of the proteins.

The nucleic acid molecules are also useful as probes for determining the chromosomal positions of the nucleic acid molecules by means of in situ hybridization methods.

The nucleic acid molecules are also useful in making vectors containing the gene regulatory regions of the nucleic acid molecules of the present invention.

The nucleic acid molecules are also useful for designing ribozymes corresponding to all, or a part, of the mRNA produced from the nucleic acid molecules described herein. The nucleic acid molecules are also useful for making vectors that express part, or all, of the peptides.

The nucleic acid molecules are also useful for constructing host cells expressing a part, or all, of the nucleic acid molecules and peptides.

The nucleic acid molecules are also useful for constructing transgenic animals expressing all, or a part, of the nucleic acid molecules and peptides.

The nucleic acid molecules are also useful as hybridization probes for determining the presence, level, form and distribution of nucleic acid expression. Experimental data as provided in Table 1 indicate that the KCATs of the present invention are expressed at differential level in various kidney cell lines and/or kidney tissues, for example, SEQ ID NOS: 1-2736. Accordingly, the probes can be used to detect the presence of, or to determine levels of, a specific nucleic acid molecule in cells, tissues, and in organisms. The nucleic acid whose level is determined can be DNA or RNA. Accordingly, probes corresponding to the peptides described herein can be used to assess expression and/or gene copy number in a given cell, tissue, or organism. These uses are relevant for diagnosis of disorders involving an increase or decrease in KCAT protein expression relative to normal results.

In vitro techniques for detection of mRNA include Northern hybridizations and in situ hybridizations. In vitro techniques for detecting DNA include Southern hybridizations and in situ hybridization.

Probes can be used as a part of a diagnostic test kit for identifying cells or tissues that express a KCAT protein, such as by measuring a level of a KCAT-encoding nucleic acid in a sample of cells from a subject e.g., mRNA or genomic DNA, or determining if a KCAT gene has been mutated. Experimental data as provided in Table 1 indicate that the KCATs of the present invention are expressed at differential level in various kidney cell lines and/or kidney tissues, for example, SEQ ID NOS: 1-2736. More detection and diagnosis methods are described in detail below.

Nucleic acid expression assays are useful for drug screening to identify compounds that modulate KCAT nucleic acid expression.

The invention thus provides a method for identifying a compound that can be used to treat a disorder associated with nucleic acid expression of the KCAT gene, particularly biological and pathological processes that are mediated by the KCAT in cells and tissues that express it. Experimental data as provided in Table 1 indicates expression in human kidney cell lines and/or kidney tumor tissues. The method typically includes assaying the ability of the compound to modulate the expression of the KCAT nucleic acid and thus identifying a compound that can be used to treat a disorder characterized by undesired KCAT nucleic acid expression. The assays can be performed in cell-based and cell-free systems. Cell-based assays include cells naturally expressing the KCAT nucleic acid or recombinant cells genetically engineered to express specific nucleic acid sequences.

The assay for KCAT nucleic acid expression can involve direct assay of nucleic acid levels, such as mRNA levels, or on collateral compounds involved in the signal pathway. Further, the expression of genes that are up- or down-regulated in response to the KCAT protein signal pathway can also be assayed. In this embodiment the regulatory regions of these genes can be operably linked to a reporter gene such as luciferase.

Thus, modulators of KCAT gene expression can be identified in a method wherein a cell is contacted with a candidate compound or agent and the expression of mRNA determined. The level of expression of KCAT mRNA in the presence of the candidate compound or agent is compared to the level of expression of KCAT mRNA in the absence of the candidate compound or agent. The candidate compound can then be identified as a modulator of nucleic acid expression based on this comparison and be used, for example to treat a disorder characterized by aberrant nucleic acid expression. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the nucleic acid as a target, using a compound or an agent identified through drug screening as a gene modulator to modulate KCAT nucleic acid expression in cells and tissues that express the KCAT. Experimental data as provided in Table 1 indicate that the KCATs of the present invention are expressed at differential level in various kidney cell lines and/or kidney tissues, for example, SEQ ID NOS: 1-2736. Modulation includes both up-regulation (i.e. activation or agonization) or down-regulation (suppression or antagonization) or nucleic acid expression.

Alternatively, a modulator for nucleic acid expression can be a small molecule or drug identified using the screening assays described herein as long as the drug or small molecule inhibits the KCAT nucleic acid expression in the cells and tissues that express the protein. Experimental data as provided in Table 1 indicates expression in human kidney cell lines and/or kidney tumor tissues.

The nucleic acid molecules are also useful for monitoring the effectiveness of modulating compounds or agents on the expression or activity of the KCAT gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

The nucleic acid molecules are also useful in diagnostic assays for qualitative changes in KCAT nucleic acid expression, and particularly in qualitative changes that lead to pathology. The nucleic acid molecules can be used to detect mutations in KCAT genes and gene expression products such as mRNA. The nucleic acid molecules can be used as hybridization probes to detect naturally occurring genetic mutations in the KCAT gene and thereby to determine whether a subject with the mutation is at risk for a disorder caused by the mutation. Mutations include deletion, addition, or substitution of one or more nucleotides in the gene, chromosomal rearrangement, such as inversion or transposition, modification of genomic DNA, such as aberrant methylation patterns or changes in gene copy number, such as amplification. Detection of a mutated form of the KCAT gene associated with a dysfunction provides a diagnostic tool for an active disease or susceptibility to disease when the disease results from overexpression, underexpression, or altered expression of a KCAT protein.

Individuals carrying mutations in the KCAT gene can be detected at the nucleic acid level by a variety of techniques. Genomic DNA can be analyzed directly or can be amplified by using PCR prior to analysis. RNA or cDNA can be used in the same way. In some uses, detection of the mutation involves the use of a probe/primer in a polymerase chain reaction (PCR) (see, e.g. U.S. Pat. Nos. 4,683,195 and 4,683,202), such as anchor PCR or RACE PCR, or, alternatively, in a ligation chain reaction (LCR) (see, e.g., Landegran et al., Science 241:1077-1080 (1988); and Nakazawa et al., PNAS 91:360-364 (1994)), the latter of which can be particularly useful for detecting point mutations in the gene (see Abravaya et al., Nucleic Acids Res. 23:675-682 (1995)). This method can include the steps of collecting a sample of cells from a patient, isolating nucleic acid (e.g., genomic, mRNA or both) from the cells of the sample, contacting the nucleic acid sample with one or more primers which specifically hybridize to a gene under conditions such that hybridization and amplification of the gene (if present) occurs, and detecting the presence or absence of an amplification product, or detecting the size of the amplification product and comparing the length to a control sample. Deletions and insertions can be detected by a change in size of the amplified product compared to the normal genotype. Point mutations can be identified by hybridizing amplified DNA to normal RNA or antisense DNA sequences.

Alternatively, mutations in a KCAT gene can be directly identified, for example, by alterations in restriction enzyme digestion patterns determined by gel electrophoresis.

Further, sequence-specific ribozymes (U.S. Pat. No. 5,498,531) can be used to score for the presence of specific mutations by development or loss of a ribozyme cleavage site. Perfectly matched sequences can be distinguished from mismatched sequences by nuclease cleavage digestion assays or by differences in melting temperature.

Sequence changes at specific locations can also be assessed by nuclease protection assays such as RNase and S1 protection or the chemical cleavage method. Furthermore, sequence differences between a mutant KCAT gene and a wild-type gene can be determined by direct DNA sequencing. A variety of automated sequencing procedures can be utilized when performing the diagnostic assays (Naeve, C. W., (1995) Biotechniques 19:448), including sequencing by mass spectrometry (see, e.g., PCT International Publication No. WO 94/16101; Cohen et al., Adv. Chromatogr. 36:127-162 (1996); and Griffin et al., Appl. Biochem. Biotechnol. 38:147-159 (1993)).

Other methods for detecting mutations in the gene include methods in which protection from cleavage agents is used to detect mismatched bases in RNA/RNA or RNA/DNA duplexes (Myers et al., Science 230:1242 (1985)); Cotton et al., PNAS 85:4397 (1988); Saleeba et al., Meth. Enzymol. 217:286-295 (1992)), electrophoretic mobility of mutant and wild type nucleic acid is compared (Orita et al., PNAS 86:2766 (1989); Cotton et al., Mutat. Res. 285:125-144

(1993); and Hayashi et al., Genet. Anal. Tech. Appl. 9:73-79 (1992)), and movement of mutant or wild-type fragments in polyacrylamide gels containing a gradient of denaturant is assayed using denaturing gradient gel electrophoresis (Myers et al., Nature 313:495 (1985)). Examples of other techniques for detecting point mutations include selective oligonucleotide hybridization, selective amplification, and selective primer extension.

The nucleic acid molecules are also useful for testing an individual for a genotype that while not necessarily causing the disease, nevertheless affects the treatment modality. Thus, the nucleic acid molecules can be used to study the relationship between an individual's genotype and the individual's response to a compound used for treatment (pharmacogenomic relationship). Accordingly, the nucleic acid molecules described herein can be used to assess the mutation content of the KCAT gene in an individual in order to select an appropriate compound or dosage regimen for treatment.

Thus nucleic acid molecules displaying genetic variations that affect treatment provide a diagnostic target that can be used to tailor treatment in an individual. Accordingly, the production of recombinant cells and animals containing these polymorphisms allow effective clinical design of treatment compounds and dosage regimens.

The nucleic acid molecules are thus useful as antisense constructs to control KCAT gene expression in cells, tissues, and organisms. A DNA antisense nucleic acid molecule is designed to be complementary to a region of the gene involved in transcription, preventing transcription and hence production of KCAT protein. An antisense RNA or DNA nucleic acid molecule would hybridize to the mRNA and thus block translation of mRNA into KCAT protein.

The nucleic acid of the present invention may also be used to specifically suppress gene expression by methods such as RNA interference (RNAi), which may also include cosuppression and quelling. This and antisense RNA or DNA of gene suppression are well known in the art. A review of this technique is found in Science 288:1370-1372, 2000. RNAi also operates on a post-transcriptional level and is sequence specific, but suppresses gene expression far more efficiently than antisense RNA. RNAi fragments, particularly double-stranded (ds) RNAi, can be also used to generate loss-of-function phenotypes.

The present invention relates to isolated RNA molecules (double-stranded; single-stranded) of from about 21 to about 25 nucleotides which mediate RNAi. As used herein, about 21 to about 25 nt includes nucleotides 17, 18, 19, 20, 21, 22, 23, 24, 25, 26, 27, 28 and 29 nucleotides in length. The isolated RNAs of the present invention mediate degradation of mRNA, the transcriptional product of a gene. Such mRNA is also referred to herein as mRNA to be degraded. As used herein, the terms RNA, RNA molecule(s), RNA segment(s) and RNA fragment(s) are used interchangeably to refer to RNA that mediates RNA interference. These terms include double-stranded RNA, single-stranded RNA, isolated RNA (partially purified RNA, essentially pure RNA, synthetic RNA, recombinantly produced RNA), as well as altered RNA that differs from naturally occurring RNA by the addition, deletion, substitution and/or alteration of one or more nucleotides. Such alterations can include addition of non-nucleotide material, such as to the end(s) of the 21-25 nt RNA or internally (at one or more nucleotides of the RNA). Nucleotides in the RNA molecules of the present invention can also comprise non-standard nucleotides, including non-naturally occurring nucleotides or deoxyribonucleotides. Collectively, all such altered RNAs are referred to as analogs or analogs of naturally-occurring RNA. RNA of 21-25 nucleotides of the present invention need only be sufficiently similar to natural RNA that it has the ability to mediate RNAi. As used herein the phrase "mediates RNAi" refers to the ability to distinguish which RNAs are to be degraded by the RNAi machinery or process. RNA that mediates RNAi interacts with the RNAi machinery such that it directs the degradation of particular mRNAs. Such RNA may include RNAs of various structure, including short hairpin RNA.

In one embodiment, the present invention relates to RNA molecules of about 21 to about 25 nucleotides that direct cleavage of specific mRNA to which their sequence corresponds. It is not necessary that there be perfect correspondence of the sequences, but the correspondence must be sufficient to enable the RNA to direct RNAi cleavage of the target mRNA (Holen et al. (2005) Nucleic Acids Res. 33, 4704-4710). In a particular embodiment, the 21-25 nt RNA molecules of the present invention comprise a 3' hydroxyl group.

The present invention relates to 21-25 nt RNAs of specific genes, produced by chemical synthesis or recombinant DNA techniques, that mediate RNAi. As used herein, the term isolated RNA includes RNA obtained by any means, including processing or cleavage of dsRNA; production by chemical synthetic methods; and production by recombinant DNA techniques. The invention further relates to uses of the 21-25 nt RNAs, such as for therapeutic or prophylactic treatment and compositions comprising 21-25 nt RNAs that mediate RNAi, such as pharmaceutical compositions comprising 21-25 nt RNAs and an appropriate carrier.

The present invention also relates to a method of mediating RNA interference of genes of a patient. In one embodiment, RNA of about 21 to about 25 nt which targets the specific mRNA to be degraded is introduced into a patient's cells. The cells are maintained under conditions allowing degradation of the mRNA, resulting in RNA-mediated interference of the mRNA of the gene in the cells of the patient. Treatment of patients with cancer with the RNAi will inhibit the growth and spread of the cancer and reduce the tumor. Treatment of patients using RNAi can also be in combination with other anti-cancer compounds. The RNAi may be used in combination with other treatment modalities, such as chemotherapy, cryotherapy, hyperthermia, radiation therapy, and other similar treatments. In one embodiment, a chemotherapy agent was combined with the RNAi. In another embodiment, a chemotherapy named Gemzar was used.

Treatment of cancer or tumors in patients requires introduction of the RNA into the cancer or tumor cells. RNA may be directly introduced into the cell, or introduced extracellularly into a cavity, interstitial space, into the circulation of a patient, or introduced orally. Methods for oral introduction include direct mixing of the RNA with food, as well as engineered approaches in which a species that is used as food is engineered to express the RNA and then ingested. Physical methods of introducing nucleic acids, for example, injection directly into the cell or extracellular injection into the patient, may also be used. Vascular or extravascular circulation, the blood or lymph system, and the cerebrospinal fluid are sites where the RNA may be introduced. RNA may be introduced into an embryonic stem cell, or another multipotent cell derived from the patient. Physical methods of introducing nucleic acids include injection of a solution containing the RNA, bombardment by particles covered by the RNA, soaking cells or tissue in a solution of the RNA, or electroporation of cell membranes in the presence of the RNA. A viral construct packaged into a viral particle may be used to introduce an expression construct into the cell, with the construct expressing RNA. Other methods known in the art for introducing nucleic acids to cells may be used, such as lipid-mediated carrier transport, chemical-mediated transport, and the like. Thus the RNA may be introduced along with components that perform one or more of the following activities: enhance RNA uptake by the cell, promote annealing of the duplex strands, stabilize the annealed strands, or otherwise increase inhibition of the target gene. The RNAi may be used in combination with other treatment modalities, such as chemotherapy, cryotherapy, hyperthermia, radiation therapy, and the like.

The present invention may be used alone or as a component of a kit having at least one of the reagents necessary to carry out the in vitro or in vivo introduction of RNA to tissue or patients. Preferred components are the dsRNA and a vehicle that promotes introduction of the dsRNA. Such a kit may also include instructions to allow a user of the kit to practice the invention.

Alternatively, a class of antisense molecules can be used to inactivate mRNA in order to decrease expression of KCAT nucleic acid. Accordingly, these molecules can treat a disorder characterized by abnormal or undesired KCAT nucleic acid expression. This technique involves cleavage by means of ribozymes containing nucleotide sequences complementary to one or more regions in the mRNA that attenuate the ability of the mRNA to be translated. Possible regions include coding regions and particularly coding regions corresponding to the catalytic and other functional activities of the KCAT protein, such as substrate binding.

The nucleic acid molecules also provide vectors for gene therapy in patients containing cells that are aberrant in KCAT gene expression. Thus, recombinant cells, which include the patient's cells that have been engineered ex vivo and returned to the patient, are introduced into an individual where the cells produce the desired KCAT protein to treat the individual.

The invention also encompasses kits for detecting the presence of a KCAT nucleic acid in a biological sample. Experimental data as provided in Table 1 indicate that the KCATs of the present invention are expressed at differential level in various kidney cell lines and/or kidney tissues, for example, SEQ ID NOS: 1-2736. For example, the kit can comprise reagents such as a labeled or labelable nucleic acid or agent capable of detecting KCAT nucleic acid in a biological sample; means for determining the amount of KCAT nucleic acid in the sample; and means for comparing the amount of KCAT nucleic acid in the sample with a standard. The compound or agent can be packaged in a suitable container. The kit can further comprise instructions for using the kit to detect KCAT protein mRNA or DNA.

Vectors/Host Cells

The invention also provides vectors containing the nucleic acid molecules described herein. The term "vector" refers to a vehicle, preferably a nucleic acid molecule, which can transport the nucleic acid molecules. When the vector is a nucleic acid molecule, the nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extrachromosomal element where it replicates and produces additional copies of the nucleic acid molecules. Alternatively, the vector may integrate into the host cell genome and produce additional copies of the nucleic acid molecules when the host cell replicates.

The invention provides vectors for the maintenance (cloning vectors) or vectors for expression (expression vectors) of the nucleic acid molecules. The vectors can function in prokaryotic or eukaryotic cells or in both (shuttle vectors).

Expression vectors contain cis-acting regulatory regions that are operably linked in the vector to the nucleic acid molecules such that transcription of the nucleic acid molecules is allowed in a host cell. The nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the nucleic acid molecules described herein can be operably linked include promoters for directing mRNA transcription. These include, but are not limited to, the left promoter from bacteriophage, the lac, TRP, and TAC promoters from E. coli, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., Molecular Cloning: A Laboratory Manual. 3rd. ed., Cold Spring Harbor Laboratory Press, Cold Spring Harbor, N.Y., (2001).

A variety of expression vectors can be used to express a nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, e.g. cosmids and phagemids. Appropriate cloning and expression vectors for prokaryotic and eukaryotic hosts are described in Sambrook et al., Molecular Cloning: A Laboratory Manual. 3rd. ed., Cold Spring Harbor Laboratory Press, Cold Spring Harbor, N.Y., (2001).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors providing for constitutive and inducible expression in prokaryotic and eukaryotic hosts are well known to those of ordinary skill in the art.

The nucleic acid molecules can be inserted into the vector nucleic acid by well-known methodology. Generally, the DNA sequence that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, *E. coli, Streptomyces*, and *Salmonella typhimurium*. Eukaryotic cells include, but are not limited to, yeast, insect cells such as Drosophila, animal cells such as COS and CHO cells, and plant cells.

As described herein, it may be desirable to express the peptide as a fusion protein. Accordingly, the invention provides fusion vectors that allow for the production of the peptides. Fusion vectors can increase the expression of a recombinant protein; increase the solubility of the recombinant protein, and aid in the purification of the protein by acting for example as a ligand for affinity purification. A proteolytic cleavage site may be introduced at the junction of the fusion moiety so that the desired peptide can ultimately be separated from the fusion moiety. Proteolytic enzymes include, but are not limited to, factor Xa, thrombin, and enteroenzyme. Typical fusion expression vectors include pGEX (Smith et al., Gene 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., Gene 69:301-315 (1988)) and pET 11d (Studier et al., Gene Expression Technology: Methods in Enzymology 185:60-89 (1990)). Recombinant protein expression can be maximized in host bacteria by providing a genetic background wherein the host cell has an impaired capacity to proteolytically cleave the recombinant protein. (Gottesman, S., Gene Expression Technology: Methods in Enzymology 185, Academic Press, San Diego, Calif. (1990) 119-128). Alternatively, the sequence of the nucleic acid molecule of interest can be altered to provide preferential codon usage for a specific host cell, for example *E. coli*. (Wada et al., Nucleic Acids Res. 20:2111-2118 (1992)).

The nucleic acid molecules can also be expressed by expression vectors that are operative in yeast. Examples of vectors for expression in yeast e.g., *S. cerevisiae* include pYepSec1 (Baldari, et al., EMBO J. 6:229-234 (1987)), pMFa (Kurjan et al., Cell 30:933-943 (1982)), pJRY88 (Schultz et al., Gene 54:113-123 (1987)), and pYES2 (Invitrogen Corporation, San Diego, Calif.).

The nucleic acid molecules can also be expressed in insect cells using, for example, baculovirus expression vectors. Baculovirus vectors available for expression of proteins in cultured insect cells (e.g., Sf 9 cells) include the pAc series (Smith et al., Mol. Cell. Biol. 3:2156-2165 (1983)) and the pVL series (Lucklow et al., Virology 170:31-39 (1989)).

In certain embodiments of the invention, the nucleic acid molecules described herein are expressed in mammalian cells using mammalian expression vectors. Examples of mammalian expression vectors include pCDM8 (Seed, B. Nature 329:840 (1987)) and pMT2PC (Kaufman et al., EMBO J. 6:187-195 (1987)).

The expression vectors listed herein are provided by way of example only of the well-known vectors available to those of ordinary skill in the art that would be useful to express the nucleic acid molecules. The person of ordinary skill in the art would be aware of other vectors suitable for maintenance propagation or expression of the nucleic acid molecules described herein. These are found for example in Sambrook, J., Fritsh, E. F., and Maniatis, T. Molecular Cloning: A Laboratory Manual. 3rd. ed., Cold Spring Harbor Laboratory Press, Cold Spring Harbor, N.Y., (2001).

The invention also encompasses vectors in which the nucleic acid sequences described herein are cloned into the vector in reverse orientation, but operably linked to a regulatory sequence that permits transcription of antisense RNA. Thus, an antisense transcript can be produced to all, or to a portion, of the nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction, infection, lipofection, and other techniques such as those found in Sambrook, et al. (Molecular Cloning: A Laboratory Manual. 3rd. ed., Cold Spring Harbor Laboratory Press, Cold Spring Harbor, N.Y., (2001).

Host cells can contain more than one vector. Thus, different nucleotide sequences can be introduced on different vectors of the same cell. Similarly, the nucleic acid molecules can be introduced either alone or with other nucleic acid molecules that are not related to the nucleic acid molecules such as those providing trans-acting factors for expression vectors. When more than one vector is introduced into a cell, the vectors can be introduced independently, co-introduced or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature proteins can be produced in bacteria, yeast, mammalian cells, and other cells under the control of the appropriate regulatory sequences, cell-free transcription and translation systems can also be used to produce these proteins using RNA derived from the DNA constructs described herein.

Where secretion of the peptide is desired, which is difficult to achieve with multi-transmembrane domain containing proteins such as KCATs, appropriate secretion signals are incorporated into the vector. The signal sequence can be endogenous to the peptides or heterologous to these peptides.

Where the peptide is not secreted into the medium, which is typically the case with KCATs, the protein can be isolated from the host cell by standard disruption procedures, including freeze thaw, sonication, mechanical disruption, use of lysing agents and the like. The peptide can then be recovered and purified by well-known purification methods including ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that depending upon the host cell in recombinant production of the peptides described herein, the peptides can have various glycosylation patterns, depending upon the cell, or maybe non-glycosylated as when produced in bacteria. In addition, the peptides may include an initial modified methionine in some cases as a result of a host-mediated process.

Uses of Vectors and Host Cells

The recombinant host cells expressing the peptides described herein have a variety of uses. First, the cells are useful for producing a KCAT protein or peptide that can be further purified to produce desired amounts of KCAT protein or fragments. Thus, host cells containing expression vectors are useful for peptide production.

Host cells are also useful for conducting cell-based assays involving the KCAT protein or KCAT protein fragments, such as those described above as well as other formats known in the art. Thus, a recombinant host cell expressing a native KCAT protein is useful for assaying compounds that stimulate or inhibit KCAT protein function.

Host cells are also useful for identifying KCAT protein mutants in which these functions are affected. If the mutants naturally occur and give rise to a pathology, host cells containing the mutations are useful to assay compounds that have a desired effect on the mutant KCAT protein (for example, stimulating or inhibiting function) which may not be indicated by their effect on the native KCAT protein.

Genetically engineered host cells can be further used to produce non-human transgenic animals. A transgenic animal is preferably a mammal, for example a rodent, such as a rat or mouse, in which one or more of the cells of the animal include a transgene. A transgene is exogenous DNA which is integrated into the genome of a cell from which a transgenic animal develops and which remains in the genome of the mature animal in one or more cell types or tissues of the transgenic animal. These animals are useful for studying the function of a KCAT protein and identifying and evaluating modulators of KCAT protein activity. Other examples of transgenic animals include non-human primates, sheep, dogs, cows, goats, chickens, and amphibians.

A transgenic animal can be produced by introducing nucleic acid into the male pronuclei of a fertilized oocyte, e.g., by microinjection, retroviral infection, and allowing the oocyte to develop in a pseudopregnant female foster animal. Any of the KCAT protein nucleotide sequences can be introduced as a transgene into the genome of a non-human animal, such as a mouse.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the KCAT protein to particular cells.

Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes animals in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. For a description of the cre/loxP recombinase system, see, e.g., Lakso et al. PNAS 89:6232-6236 (1992). Another example of a recombinase system is the FLP recombinase system of S. cerevisiae (O'Gorman et al. Science 251: 1351-1355 (1991). If a cre/loxP recombinase system is used to regulate expression of the transgene, animals containing transgenes encoding both the Cre recombinase and a selected protein is required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. Nature 385:810-813 (1997) and PCT International Publication Nos. WO 97/07668 and WO 97/07669. In brief, a cell, e.g., a somatic cell, from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell, e.g., the somatic cell, is isolated.

Transgenic animals containing recombinant cells that express the peptides described herein are useful to conduct the assays described herein in an in vivo context. Accordingly, the various physiological factors that are present in vivo and that could effect substrate binding, KCAT protein activation, and signal transduction, may not be evident from in vitro cell-free or cell-based assays. Accordingly, it is useful to provide non-human transgenic animals to assay in vivo KCAT protein function, including substrate interaction, the effect of specific mutant KCAT proteins on KCAT protein function and substrate interaction, and the effect of chimeric KCAT proteins. It is also possible to assess the effect of null mutations, that is, mutations that substantially or completely eliminate one or more KCAT protein functions.

Detection and Diagnosis

The present invention provides a method for detecting KCAT nucleic acids, proteins, peptides and fragments thereof that are differentially expressed in kidney diseases in a test sample, preferably in a biological sample.

The present invention further provides a method for diagnosing the kidney diseases, by detecting the nucleic acids, proteins, peptides and fragments thereof. The further embodiment includes but is not limited to, monitoring the disease prognosis (reoccurrence), diagnosing disease stage, preventing the disease and treating the disease. While the protein is overexpressed, the expression of KCAT is preferably greater than about 20%, or preferably greater than about 30%, and most preferably greater than about 50% or more of kidney disease sample, at a level that is at least two fold, and preferably at least five fold, greater than the level of expression in control samples, as determined using a representative assay provided herein. While the protein is underexpressed, the expression of KCAT is preferably less than about 20%, or preferably less than 30%, and most preferably less than about 50% or more of the kidney disease sample, at a level that is at least 0.5 fold, and preferably at least 0.2 fold less than the level of the expression in control samples, as determined using a representative assay provided herein.

As used herein, a "biological sample" can be collected from tissues, blood, sera, cell lines or biological fluids such as, plasma, interstitial fluid, urine, cerebrospinal fluid, and the like, containing cells. In preferred embodiments, a biological sample comprises cells or tissues suspected of having diseases (e.g., cells obtained from a biopsy).

As used herein, a "differential level" is defined as the level of KCAT protein or nucleic acids in a test sample either above or below the level of the ones in control samples, wherein the level of control samples is obtained either from a control cell line, a normal tissue or body fluids, or combination thereof, from a healthy subject.

As used herein, a "subject" can be a mammalian subject or non mammalian subject, preferably, a mammalian subject. A mammalian subject can be human or non-human, preferably human. A healthy subject is defined as a subject without detectable kidney diseases or kidney associated diseases by using conventional diagnostic methods.

As used herein the "diseases" include kidney diseases and kidney associated disease.

As used herein, "cancer" includes epithelial-cell related cancers, for example kidney, pancreatic, lung, colon, prostate, ovarian, breast, and bladder cancer.

Nucleic Acid Detections

The present invention is not limited to the detection methods described above. Any suitable detection method that allows for the specific detection of kidney diseases cells, tissues or organs may be utilized. For example, in some embodiments, the expression of RNA corresponding to a KCAT gene is detected by hybridization to an antisense oligonucleotide (described below). In other embodiments, RNA expression is detected by hybridization assays such as Northern blots, RNase assays, reverse transcriptase PCR amplification, and the like. One preferred detection method is using RT PCR by using TaqMan technology (ABI, Foster City, Calif.).

In another embodiment, the present invention provides a method for diagnosing or detecting kidney diseases in a subject comprising: determining the level of one or more KCAT nucleic acid molecules or any fragment(s) thereof in a test sample from said subject, wherein said KCAT nucleic acid molecule(s) comprises a sequence selected from a group consisting of SEQ ID NOS: 2737-5164 and a combination thereof; wherein a differential level of said KCAT nucleic acid molecule(s) relative to the level of said nucleic acid molecule(s) in a test sample from a healthy subject, or the level established for a healthy subject, is indicative of kidney diseases.

In another embodiment, the detecting or diagnosing method comprises determining level of differential expression of 2, 4, 8, 10, 20 or more nucleic acid molecules, preferably, the nucleic acid molecules comprise or consists of a sequence selected from the group consisting of SEQ ID NOS: 2737-5164 and combination thereof.

In further embodiments of the present invention, the presence of particular sequences in the genome of a subject is detected. Such sequences include KCAT sequences associated with abnormal expression of KCAT (e.g., overexpression or expression at a physiological inappropriate time). These sequences include polymorphisms, including polymorphisms in the transcribed sequence (e.g., that effect KCAT processing and/or translation) and regulatory sequences such as promoters, enhances, repressors, and the like. These sequences may also include polymorphisms in genes or control sequences associated with factors that affect expression such as transcription factors, and the like. Any suitable method for detecting and/or identifying these sequences is within the scope of the present invention including, but not limited to, nucleic acid sequencing, hybridization assays (e.g., Southern blotting), single nucleotide polymorphism assays (See e.g., U.S. Pat. No. 5,994,069, herein incorporated by reference in its entirety), and the like.

Protein Detections

The present invention provides methods for diagnosing or detecting the differential presence of KCAT protein. In some embodiments (e.g., where KCATs are overexpressed in diseased cells), KCAT proteins are detected directly. In other embodiments (e.g., where the presence of a KCATs are underexpressed), KCAT to the disease antigens are detected non-existence.

The diagnostic methods of the present invention find utility in the diagnosis and characterization of diseases. For example, the presence of an antibody to a specific protein may be indicative of a cancer or disease. In addition, certain KCAT may be indicative of a specific stage or sub-type of the same cancer or disease.

The information obtained is also used to determine prognosis and appropriate course of treatment. For example, it is contemplated that individuals with a specific KCAT expression or stage of kidney diseases may respond differently to a given treatment that individuals lacking the KCAT expression. The information obtained from the diagnostic methods of the present invention thus provides for the personalization of diagnosis and treatment.

In one embodiment, the present invention provides a method for monitoring kidney diseases treatment in a subject comprising: determining the level of one or more KCAT proteins or any fragment(s) or peptide(s) thereof in a test sample from said subject, wherein said KCAT protein(s) comprises a sequence selected from a group consisting of SEQ ID NOS: 1-2736, SEQ ID NOS: 5165-6044 and a combination thereof; wherein an level of said KCAT protein(s) similar to the level of said protein(s) in a test sample from a healthy subject, or the level established for a healthy subject, is indicative of successful treatment.

In another embodiment, the present invention provides a method for diagnosing recurrence of kidney diseases following successful treatment in a subject comprising: determining the level of one or more KCAT proteins or any fragment(s) or peptide(s) hereof in a test sample from said subject, wherein said KCAT protein(s) comprises a sequence selected from a group consisting of SEQ ID NOS: 1-2736, SEQ ID NOS: 5165-6044 or a combination thereof; wherein a changed level of said KCAT protein(s) relative to the level of said protein(s) in a test sample from a healthy subject, or the level established for a healthy subject, is indicative of recurrence of kidney diseases.

In yet another embodiment, the presend invention provides a method for diagnosing or detecting kidney diseases in a subject comprising: determining the level of one or more KCAT proteins or any fragment(s) or peptides thereof in a test sample from said subject, wherein said KCAT protein(s) comprises a sequence selected from a group consisting of SEQ ID NOS: 1-2736, SEQ ID NOS: 5165-6044 and a combination thereof; wherein a differential level of said KCAT protein(s) relative to the level of said protein(s) in a test sample from a healthy subject, or the level established for a healthy subject, is indicative of kidney diseases.

The detecting or diagnosing method comprises determining level of differential expression of 2, 4, 8, 10, 20 or more proteins, preferably, the proteins are selected from a group consisting of SEQ ID NOS: 1-2736 and combination thereof.

Further, the detecting or diagnosing method comprises determining level of differential expression of 5, 10, 15, 20, 40, 60, 80, 100 or more KCAT peptides, preferably the peptides are selected from the group consisting of SEQ ID NOS: 5165-6044 and combination thereof.

These methods are also useful for diagnosing diseases that show differential protein expression. As describe earlier, normal, control or standard values or level established from a healthy subject for protein expression are established by combining body fluids or tissue, cell extracts taken from a normal healthy mammalian or human subject with specific antibodies to a protein under conditions for complex formation. Standard values for complex formation in normal and diseased tissues are established by various methods, often photometric means. Then complex formation as it is expressed in a subject sample is compared with the standard values. Deviation from the normal standard and toward the diseased standard provides parameters for disease diagnosis or prognosis while deviation away from the diseased and toward the normal standard may be used to evaluate treatment efficacy.

In yet another embodiment, the present invention provides a detection or diagnostic method of KCATs by using LC/MS. The proteins from cells are prepared by methods known in the art (R. Aebersold Nature Biotechnology Volume 21 Number 6 Jun. 2003). The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample. The LC/MS spectra are collected for the labeled samples. The raw scans from the LC/MS instrument are subjected to peak detection and noise reduction software. Filtered peak lists are then used to detect 'features' corresponding to specific peptides from the original sample(s). Features are characterized by their mass/charge, charge, retention time, isotope pattern and intensity.

The intensity of a peptide present in both healthy and disease samples can be used to calculate the differential expression, or relative abundance, of the peptide. The intensity of a peptide found exclusively in one sample can be used to calculate a theoretical expression ratio for that peptide (singleton). Expression ratios are calculated for each peptide of each replicate of the experiment (Table 1). Thus overexpression or under expression of KCAT protein or peptide are similar to the expression pattern in Table 1 in a test subject indicates the likelihood of having kidney diseases or diseases associated with kidney.

Immunological methods for detecting and measuring complex formation as a measure of protein expression using either specific polyclonal or monoclonal antibodies are known in the art. Examples of such techniques include enzyme-linked immunosorbent assays (ELISAs), radioimmunoassays (RIAs), fluorescence-activated cell sorting (FACS) and antibody arrays. Such immunoassays typically involve the measurement of complex formation between the protein and its specific antibody. These assays and their quantitation against purified, labeled standards are well known in the art (Ausubel, supra, unit 10.1-10.6). A two-site, monoclonal-based immunoassay utilizing antibodies reactive to two non-interfering epitopes is preferred, but a competitive binding assay may be employed (Pound (1998) Immunochemical Protocols, Humana Press, Totowa N.J.). More immunological detections are described in section below.

Antibody Detections

Antibodies are useful to detect the presence of one of the proteins or fragments thereof, peptides of the present invention in cells or tissues to determine the pattern of expression of the protein among various tissues in an organism and over the course of normal development.

Further, as described above, the antibodies can be used to assess expression in disease states such as in active stages of the disease or in an individual with a predisposition toward disease related to the protein's function. The antibodies can also be used to assess normal and aberrant subcellular localization of cells in the various tissues in an organism.

Detection on a protein by an antibody can be facilitated by coupling (i.e., physically linking) the antibody to a detectable substance. Examples of detectable substances include various enzymes, prosthetic groups, fluorescent materials, luminescent materials, bioluminescent materials, and radioactive materials (see below). The antibodies may also be useful in diagnostic assays, e.g., for detecting expression of an antigen, for example KCAT protein, peptide or fragment thereof, in specific cells, tissues, blood, serum or body fluids.

For diagnostic applications, the antibody or its variant typically will be labeled with a detectable moiety. Numerous labels are available which can be generally grouped into the following categories:

(a) Radioisotopes, such as $^{36}$S, $^{14}$C, $^{125}$I, $^{3}$H, and $^{131}$I. The antibody variant can be labeled with the radioisotope using the techniques described in Current Protocols in Immunology, vol 1-2, Coligen et al., Ed., Wiley-Interscience, New York, Pubs. (1991) for example and radioactivity can be measured using scintillation counting.

(b) Fluorescent labels such as rare earth chelates (europium chelates) or fluorescein and its derivatives, rhodamine and its derivatives, dansyl, Lissamine, phycoerythrin and Texas Red are available. The fluorescent labels can be conjugated to the antibody variant using the techniques disclosed in Current Protocols in Immunology, supra, for example. Fluorescence can be quantified using a fluorimeter.

(c) Various enzyme-substrate labels are available and U.S. Pat. Nos. 4,275,149, 4,318,980 provides a review of some of these. The enzyme generally catalyzes a chemical alteration of the chromogenic substrate which can be measured using various techniques. For example, the enzyme may catalyze a color change in a substrate, which can be measured spectrophotometrically. Alternatively, the enzyme may alter the fluorescence or chemiluminescence of the substrate. Techniques for quantifying a change in fluorescence are described above. The chemiluminescent substrate becomes electronically excited by a chemical reaction and may then emit light which can be measured (using a chemiluminometer, for example) or donates energy to a fluorescent acceptor. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRPO), alkaline phosphatase, beta.-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Techniques for conjugating enzymes to antibodies are described in O'Sullivan et al., Methods for the Preparation of Enzyme-Antibody Conjugates for Use in Enzyme Immunoassay, in Methods in Enzyme. (Ed. J. Langone & H. Van Vunakis), Academic press, New York, 73: 147-166 (1981).

Sometimes, the label is indirectly conjugated with the antibody. The skilled artisan will be aware of various techniques for achieving this. For example, the antibody can be conjugated with biotin and any of the three broad categories of labels mentioned above can be conjugated with avidin, or vice versa. Biotin binds selectively to avidin and thus, the label can be conjugated with the antibody in this indirect manner. Alternatively, to achieve indirect conjugation of the label with the antibody, the antibody is conjugated with a small hapten (e.g. digloxin) and one of the different types of labels mentioned above is conjugated with an anti-hapten antibody (e.g. anti-digloxin antibody). Thus, indirect conjugation of the label with the antibody can be achieved.

In another embodiment of the invention, the antibody need not be labeled, and the presence thereof can be detected using a labeled antibody, which binds to the antibody.

The antibodies of the present invention may be employed in any known assay method, such as competitive binding assays, direct and indirect sandwich assays, and immunoprecipitation assays. Zola, Monoclonal Antibodies: A Manual of Techniques, pp. 147-158 (CRC Press, Inc. 1987).

The biological samples can then be tested directly for the presence of KCAT by assays (e.g., ELISA or radioimmunoassay) and format (e.g., microwells, dipstick (e.g., as described in International Patent Publication WO 93/03367), etc). Alternatively, proteins in the sample can be size separated (e.g., by polyacrylamide gel electrophoresis (PAGE)), in the presence or absence of sodium dodecyl sulfate (SDS), and the presence of KCAT detected by immunoblotting (e.g., Western blotting). Immunoblotting techniques are generally more effective with antibodies generated against a peptide corresponding to an epitope of a protein, and hence, are particularly suited to the present invention.

Antibody binding is detected by techniques known in the art (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention. As is well known in the art, the immunogenic peptide should be provided free of the carrier molecule used in any immunization protocol. For example, if the peptide was conjugated to KLH, it may be conjugated to BSA, or used directly, in a screening assay. In some embodiments, an automated detection assay is utilized. Methods for the automation of immunoassays are well known in the art (See e.g., U.S. Pat. Nos. 5,885,530, 4,981,785, 6,159,750, and 5,358,691, each of which is herein incorporated by reference). In some embodiments, the analysis and presentation of results is also automated. For example, in some embodiments, software that generates a prognosis based on the presence or absence of a series of antigens is utilized.

Competitive binding assays rely on the ability of a labeled standard to compete with the test sample for binding with a limited amount of antibody. The amount of antigen in the test sample is inversely proportional to the amount of standard that becomes bound to the antibodies. To facilitate determining the amount of standard that becomes bound, the antibodies generally are insolubilized before or after the competition. As a result, the standard and test sample that are bound to the antibodies may conveniently be separated from the standard and test sample, which remain unbound.

Sandwich assays involve the use of two antibodies, each capable of binding to a different immunogenic portion, or epitope, or the protein to be detected. In a sandwich assay, the test sample to be analyzed is bound by a first antibody, which is immobilized on a solid support, and thereafter a second antibody binds to the test sample, thus forming an insoluble three-part complex. See e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

The antibodies may also be used for in vivo diagnostic assays. Generally, the antibody is labeled with a radionucleotide (such as $^{111}$In, $^{99}$Tc, $^{14}$C, $^{131}$I, $^{3}$H, 32 P or $^{35}$S) so that the tumor can be localized using immunoscintiography. In one embodiment, antibodies or fragments thereof bind to the extracellular domains of two or more KCAT targets and the affinity value(Kd) is less than $1 \times 10^8$ M.

Antibodies for diagnostic use may be labeled with probes suitable for detection by various imaging methods. Methods for detection of probes include, but are not limited to, fluorescence, light, confocal and electron microscopy; magnetic resonance imaging and spectroscopy; fluoroscopy, computed tomography and positron emission tomography. Suitable probes include, but are not limited to, fluorescein, rhodamine, eosin and other fluorophores, radioisotopes, gold, gadolinium and other lanthanides, paramagnetic iron, fluorine-18 and other positron-emitting radionuclides. Additionally, probes may be bi- or multi-functional and be detectable by more than one of the methods listed. These antibodies may be directly or indirectly labeled with said probes. Attachment of probes to the antibodies includes covalent attachment of the probe, incorporation of the probe into the antibody, and the covalent attachment of a chelating compound for binding of probe, amongst others well recognized in the art.

For immunohistochemistry, the disease tissue sample may be fresh or frozen or may be embedded in paraffin and fixed with a preservative such as formalin (see Example). The fixed or embedded section contains the sample are contacted with a labeled primary antibody and secondary antibody, wherein the antibody is used to detect the KCAT protein express in situ. The detailed procedure is shown in the Example.

Array:

Array technologies and quantitative PCR provide the means to explore the expression profiles of a large number of related or unrelated genes, and proteins. When an expression profile is examined, arrays provide a platform for examining which genes or proteins are tissue-specific, carrying out housekeeping functions, parts of a signaling cascade, or specifically related to a particular genetic predisposition, condition, disease, or disorder. The potential application of gene or protein expression profiling is particularly relevant to improving diagnosis, prognosis, and treatment of disease. For example, both the sequences and the amount of expression can be compared between tissues from subjects with different types of kidney diseases and cytologically normal healthy tissue.

"Array" refers to an ordered arrangement of at least two transcripts, proteins or peptides, or antibodies on a substrate. At least one of the transcripts, proteins, or antibodies represents a control or standard, and the other transcript, protein, or antibody is of diagnostic or therapeutic interest. The arrangement of at least two and up to about 40,000 transcripts, proteins, or antibodies on the substrate assures that the size and signal intensity of each labeled complex, formed between each transcript and at least one nucleic acid, each protein and at least one ligand or antibody, or each antibody and at least one protein to which the antibody specifically binds, is individually distinguishable.

An "expression profile" is a representation of gene expression in a sample. A nucleic acid expression profile is produced using sequencing, hybridization, or amplification technologies using transcripts from a sample. A protein expression profile, although time delayed, mirrors the nucleic acid expression profile and is produced using gel electrophoresis, mass spectrometry, or an array and labeling moieties or antibodies which specifically bind the protein. The nucleic acids, proteins, or antibodies specifically binding the protein may be used in solution or attached to a substrate, and their detection is based on methods well known in the art.

A substrate includes but not limited to, paper, nylon or other type of membrane, filter, chip, glass slide, or any other suitable solid support.

The invention also provides an array with a cDNA or transcript encoding KCAT proteins or peptides or fragments thereof, antibodies which specifically bind KCAT proteins, peptides or fragments thereof. Preferably, two or more of the nucleic acid molecules (e.g., SEQ ID NOS: 2737-5164), proteins (e.g., SEQ ID NOS: 1-2736) or peptides (e.g., SEQ ID NOS: 5165-6044) are immobilized on a substrate.

The present invention also provides an antibody array. Antibody arrays have allowed the development of techniques for high-throughput screening of recombinant antibodies. Such methods use robots to pick and grid bacteria containing antibody genes, and a filter-based ELISA to screen and identify clones that express antibody fragments. Because liquid handling is eliminated and the clones are arrayed from master stocks, the same antibodies can be spotted multiple times and screened against multiple antigens simultaneously. For more information, see de Wildt et al. (2000) Nat Biotechnol 18:989-94.

The array is prepared and used according to the methods described in U.S. Pat. No. 5,837,832, Chee et al., PCT application WO95/11995 (Chee et al.), Lockhart, D. J. et al. (1996; Nat. Biotech. 14: 1675-1680) and Schena, M. et al. (1996; Proc. Natl. Acad. Sci. 93: 10614-10619), U.S. Pat. No. 5,807, 522, Brown et al., all of which are incorporated herein in their entirety by reference.

In one embodiment, a nucleic acid array or a microarray, preferably composed of a large number of unique, single-stranded nucleic acid sequences, usually either synthetic antisense oligonucleotides or fragments of cDNAs, fixed to a solid support. The oligonucleotides are preferably about 6-60 nucleotides in length, more preferably 15-30 nucleotides in length, and most preferably about 20-25 nucleotides in length.

In order to produce oligonucleotides to a known sequence for an array, the gene(s) of interest (or an ORF identified from the contigs of the present invention) is typically examined using a computer algorithm which starts at the 5' or at the 3' end of the nucleotide sequence. Typical algorithms will then identify oligomers of defined length that are unique to the gene, have a GC content within a range suitable for hybridization, and lack predicted secondary structure that may interfere with hybridization. In certain situations it may be appropriate to use pairs of oligonucleotides on an array. The "pairs" will be identical, except for one nucleotide that preferably is located in the center of the sequence. The second oligonucleotide in the pair (mismatched by one) serves as a control. The number of oligonucleotide pairs may range from two to one million. The oligomers are synthesized at designated areas on a substrate using a light-directed chemical process, wherein the substrate may be paper, nylon or other type of membrane, filter, chip, glass slide or any other suitable solid support as described above.

In another aspect, an oligonucleotide may be synthesized on the surface of the substrate by using a chemical coupling procedure and an ink jet application apparatus, as described in PCT application WO95/251116 (Baldeschweiler et al.) which is incorporated herein in its entirety by reference.

A gene expression profile comprises the expression of a plurality of transcripts as measured by after hybridization with a sample. The transcripts of the invention may be used as elements on an array to produce a gene expression profile. In one embodiment, the array is used to diagnose or monitor the progression of disease. Researchers can assess and catalog the differences in gene expression between healthy and diseased tissues or cells.

For example, the transcript or probe may be labeled by standard methods and added to a biological sample from a patient under conditions for the formation of hybridization complexes. After an incubation period, the sample is washed and the amount of label (or signal) associated with hybridization complexes, is quantified and compared with a standard value. If complex formation in the patient sample is significantly altered (higher or lower) in comparison to either a normal or disease standard, then differential expression indicates the presence of a disorder.

In order to provide standards for establishing differential expression, normal and disease expression profiles are established. This is accomplished by combining a sample taken from normal subjects, either animal or human or nonmammal, with a transcript under conditions for hybridization to occur. Standard hybridization complexes may be quantified by comparing the values obtained using normal subjects with values from an experiment in which a known amount of a purified sequence is used. Standard values obtained in this manner may be compared with values obtained from samples from patients who were diagnosed with a particular condition, disease, or disorder. Deviation from standard values toward those associated with a particular disorder is used to diagnose that disorder.

By analyzing changes in patterns of gene expression, disease can be diagnosed at earlier stages before the patient is symptomatic. The invention can be used to formulate a prognosis and to design a treatment regimen. The invention can also be used to monitor the efficacy of treatment. For treatments with known side effects, the array is employed to improve the treatment regimen. A dosage is established that causes a change in genetic expression patterns indicative of successful treatment. Expression patterns associated with the onset of undesirable side effects are avoided.

In another embodiment, animal models which mimic a human disease can be used to characterize expression profiles associated with a particular condition, disease, or disorder; or treatment of the condition, disease, or disorder. Novel treatment regimens may be tested in these animal models using arrays to establish and then follow expression profiles over time. In addition, arrays may be used with cell cultures or tissues removed from animal models to rapidly screen large numbers of candidate drug molecules, looking for ones that produce an expression profile similar to those of known therapeutic drugs, with the expectation that molecules with the same expression profile will likely have similar therapeutic effects. Thus, the invention provides the means to rapidly determine the molecular mode of action of a drug.

Such assays may also be used to evaluate the efficacy of a particular therapeutic treatment regimen in animal studies or in clinical trials or to monitor the treatment of an individual patient. Once the presence of a condition is established and a treatment protocol is initiated, diagnostic assays may be repeated on a regular basis to determine if the level of expression in the patient begins to approximate that which is observed in a normal subject. The results obtained from successive assays may be used to show the efficacy of treatment over a period ranging from several days to years.

Treatment

The following terms, as used in the present specification and claims, are intended to have the meaning as defined below, unless indicated otherwise.

"Treat," "treating" or "treatment" of a disease includes:

(1) inhibiting the disease, i.e., arresting or reducing the development of the disease or its clinical symptoms, or (2) relieving the disease, i.e., causing regression of the disease or its clinical symptoms.

A "therapeutically effective amount" means the amount of an agent that, when administered to a subject for treating a disease, is sufficient to effect such treatment for the disease. The "therapeutically effective amount" will vary depending on the agent, the disease and its severity and the age, weight, etc., of the subject to be treated.

A "kidney disease" includes kidney cancer, kidney tumor (exocrine or endocrine), kidney cysts as well as kidney trauma; preferably kidney cancer.

A "cancer" is epithelial-cell related cancers. For example, kidney, pancreatic, lung, colon, prostate, ovarian, breast, and bladder cancer.

The present invention provides an application of treatment by using antibody, immunogenic peptides as well as other KCAT agonists or antagonists.

KCATs are proteins differentially expressed in the kidney diseases cell lines or tissues. The proteins are either cell surface proteins, secreted proteins, or cytosolic proteins (see the list in Table 1). These proteins are associated with the diseases especially kidney diseases, particularly kidney cancer; thus, they serve as candidate targets for the treatment of the diseases.

In one embodiment, when decreased expression or activity of the protein is desired, an inhibitor, antagonist, antibody and the like or a pharmaceutical agent containing one or more of these molecules may be delivered. Such delivery may be effected by methods well known in the art and may include delivery by an antibody specifically targeted to the protein. Neutralizing antibodies, which inhibit dimer formation, are generally preferred for therapeutic use.

In another embodiment, when increased expression or activity of the protein is desired, the protein, an agonist, an enhancer and the like or a pharmaceutical agent containing one or more of these molecules may be delivered. Such delivery may be effected by methods well known in the art and may include delivery of a pharmaceutical agent by an antibody specifically targeted to the protein.

Any of the transcripts, complementary molecules, or fragments thereof, proteins or portions thereof, vectors delivering these nucleic acid molecules or expressing the proteins, and their ligands may be administered in combination with other therapeutic agents. Selection of the agents for use in combination therapy may be made by one of ordinary skill in the art according to conventional pharmaceutical principles. A combination of therapeutic agents may act synergistically to affect treatment of a particular disorder at a lower dosage of each agent.

Antibody Therapy

The antibody of the present invention can be used for therapeutic reason. It is contemplated that the antibody of the present invention may be used to treat a mammal, preferably human with kidney diseases.

In general, the antibodies are also useful for inhibiting protein function, for example, blocking the binding of the KCAT protein or peptide to a binding partner such as a substrate. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated within a cell or cell membrane. The function blocking assays are provided in detail in the Examples.

The antibodies of present invention can also be used as means of enhancing the immune response. The antibodies can be administered in amounts similar to those used for other therapeutic administrations of antibody. For example, pooled gamma globulin is administered at a range of about 1 mg to about 100 mg per patient. Thus, antibodies reactive with the protein or peptides of KCAT can be passively administered alone or in conjunction with other anti-cancer therapies to a mammal afflicted-with kidney diseases or cancer. Examples of anti-cancer therapies include, but are not limited to, chemotherapy, radiation therapy, adoptive immunotherapy therapy with TIL (Tumor Infiltration Lymphocytes).

The selection of an antibody subclass for therapy will depend upon the nature of the disease tumor antigen. For example, an IgM may be preferred in situations where the antigen is highly specific for the diseased target and rarely occurs on normal cells. However, where the disease-associated antigen is also expressed in normal tissues, although at much lower levels, the IgG subclass may be preferred for the following reason: since the binding of at least two IgG molecules in close proximity is required to activate complement, less complement mediated damage may occur in the normal tissues which express smaller amounts of the antigen and, therefore, bind fewer IgG antibody molecules. Furthermore, IgG molecules by being smaller may be more able than IgM molecules to localize to the diseased tissue.

The mechanism for antibody therapy is that the therapeutic antibody recognizes a cell surface protein, a secreted protein, or a cytosolic protein that is overexpressed in diseased cells. By NK cell or complement activation, conjugation of the antibody with an immunotoxin or radiolabel, the interaction can abrogate ligand/receptor interaction or activation of apoptosis.

The potential mechanisms of antibody-mediated cytotoxicity of diseased cells are phagocyte (antibody dependent cellular cytotoxicity (ADCC)) (see Example), complement (Complement-mediated cytotoxicity (CMC)) (see Example), naked antibody (receptor cross-linking apoptosis and growth factor inhibition), or targeted payload labeled with radionuclide or immunotoxins or immunochemotherapeutics.

In one embodiment, the antibody is administered to a nonhuman mammal for the purposes of obtaining preclinical data, for example. Exemplary nonhuman mammals to be treated include nonhuman primates, dogs, cats, rodents and other mammals in which preclinical studies are performed. Such mammals may be established animal models for a disease to be treated with the antibody or may be used to study toxicity of the antibody of interest. In each of these embodiments, dose escalation studies may be performed on the mammal.

The antibody is administered by any suitable means, including parenteral, subcutaneous, intraperitoneal, intrapulmonary, and intranasal, and, if desired for local immunosuppressive treatment, intralesional administration. Parenteral infusions include intramuscular, intravenous, intraarterial, intraperitoneal, or subcutaneous administration. In addition, the antibody variant is suitably administered by pulse infusion, particularly with declining doses of the antibody variant. Preferably the dosing is given by injections, most preferably intravenous or subcutaneous injections, depending in part on whether the administration is brief or chronic.

For the prevention or treatment of a disease, the appropriate dosage of the antibody will depend on the type of disease to be treated, the severity and the course of the disease, whether the antibody is administered for preventive or therapeutic purposes, previous therapy, the patient's clinical history and response to the antibody, and the discretion of the attending physician.

Depending on the type and severity of the disease, about 1.mu.g/kg to 150 mg/kg (e.g., 0.1-20 mg/kg) of antibody is an initial candidate dosage for administration to the patient, whether, for example, by one or more separate administrations, or by continuous infusion. A typical daily dosage might range from about 1.mu.g/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy is easily monitored by conventional techniques and assays.

The antibody composition will be formulated, dosed and administered in a manner consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

The therapeutically effective amount of the antibody to be administered will be governed by such considerations, and is the minimum amount necessary to prevent, ameliorate, or treat a disease or disorder. The antibody need not be, but is optionally formulated with one or more agents currently used to prevent or treat the disorder in question.

Antibodies of the present invention may also be used as therapeutic reagents, to diminish or eliminate cancer or tumors. For example, the antibodies may be used on their own (for instance, to inhibit metastases) or coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, Pseudomonas exotoxin, Shigella toxin, and pokeweed antiviral protein A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be affected, for example, through amino groups, carboxyl groups, sulfhydryl groups or oxidized carbohydrate residues. There are numerous references describing such methodology, e.g. U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671, 958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways as described above.

While it is possible for the immunogen to be administered in a pure or substantially pure form, it is preferable to present it as a pharmaceutical composition, formulation or preparation with a carrier.

The formulations of the present invention, both for veterinary and for human use, comprise an immunogen as described above, together with one or more pharmaceutically acceptable carriers and, optionally, other therapeutic ingredients. The carrier(s) must be "acceptable" in the sense of being compatible with the other ingredients of the formulation and not deleterious to the recipient thereof. The formulations may conveniently be presented in unit dosage form and may be prepared by any method well-known in the pharmaceutical art.

Suitable pharmaceutical carriers include proteins such as albumins (e.g., U.S. Pat. No. 4,507,234, to Kato et al.), peptides and polysaccharides such as aminodextran (e.g., U.S. Pat. No. 4,699,784, to Shih et al.), or water. A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, metal oxide, radionuclide. For example, U.S. Pat. No. 4,673,562, to Davison et al. discloses representative chelating compounds and their synthesis.

All methods include the step of bringing into association the active ingredient with the carrier, which constitutes one or more accessory ingredients. In general, the formulations are prepared by uniformly and intimately bringing into association the active ingredient with liquid carriers or finely divided solid carriers or both, and then, if necessary, shaping the product into the desired formulation.

Formulations suitable for intravenous intramuscular, subcutaneous, or intraperitoneal administration conveniently comprise sterile aqueous solutions of the active ingredient with solutions, which are preferably isotonic with the blood of the recipient. Such formulations may be conveniently prepared by dissolving solid active ingredient in water containing physiologically compatible substances such as sodium chloride (e.g. 0.1-2.0M), glycine, and the like, and having a buffered pH compatible with physiological conditions to produce an aqueous solution, and rendering said solution sterile. These may be present in unit or multi-dose containers, for example, sealed ampoules or vials.

The formulations of the present invention may incorporate a stabilizer. Illustrative stabilizers are polyethylene glycol, proteins, saccharides, amino acids, inorganic acids, and organic acids, which may be used either on their own or as admixtures. These stabilizers are preferably incorporated in an amount of 0.11-10,000 parts by weight per part by weight of immunogen. If two or more stabilizers are to be used, their total amount is preferably within the range specified above. These stabilizers are used in aqueous solutions at the appropriate concentration and pH. The specific osmotic pressure of such aqueous solutions is generally in the range of 0.1-3.0 osmoles, preferably in the range of 0.8-1.2. The pH of the aqueous solution is adjusted to be within the range of 5.0-9.0, preferably within the range of 6-8. In formulating the antibody of the present invention, anti-adsorption agent may be used.

Additional pharmaceutical methods may be employed to control the duration of action. Controlled release preparations may be achieved through the use of polymer to complex or absorb the proteins or their derivatives. The controlled delivery may be exercised by selecting appropriate macromolecules (for example polyester, polyamino acids, polyvinyl, pyrrolidone, ethylenevinylacetate, methylcellulose, carboxymethylcellulose, or protamine sulfate) and the concentration of macromolecules as well as the methods of incorporation in order to control release. Another possible method to control the duration of action by controlled-release preparations is to incorporate the KCAT antibody into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization, for example, hydroxymethylcellulose or gelatin-microcapsules and poly (methylmethacylate) microcapsules, respectively, or in colloidal drug delivery systems, for example, liposomes, albumin microspheres, microemulsions, nanoparticles, and nanocapsules or in macroemulsions.

When oral preparations are desired, the compositions may be combined with typical carriers, such as lactose, sucrose, starch, talc magnesium stearate, crystalline cellulose, methyl cellulose, carboxymethyl cellulose, glycerin, sodium alginate or gum arabic among others.

The therapeutic antibody may be supplied in the form of a kit, alone, or in the form of a pharmaceutical composition as described above.

Other Immunotherapy

The KCAT proteins or peptides or fragments thereof of this invention are also intended for use in producing antiserum designed for pre- or post-disease prophylaxis. Here the protein, peptides or fragment thereof, is formulated with a suitable adjuvant and administered by injection to human volunteers, according to known methods for producing human antisera. Antibody response to the injected proteins is monitored, during a several-week period following immunization, by periodic serum sampling to detect the presence of antiserum antibodies, using an immunoassay as described herein.

The antiserum from immunized individuals may be administered as a prophylactic measure for individuals who are at risk of developing kidney diseases or cancer. The antiserum is also useful in treating an individual afflicted with kidney diseases or cancer for post-disease prophylaxis.

Alternatively, peptides derived form the KCAT protein sequence may be modified to increase their immunogenicity by enhancing binding of the peptide to the MHC molecules in which the peptide is presented. The peptide or modified peptide may be conjugated to a carrier molecule to enhance the antigenicity of the peptide. Examples of carrier molecules, include, but are not limited to, human albumin, bovine albumin, lipoprotein and keyhole limpet hemo-cyanin ("Basic and Clinical Immunology" (1991) Stites, D. P. and Terr A. I. (eds) Appleton and Lange, Norwalk Conn., San Mateo, Calif.).

An "immunogenic peptide" is a peptide, which comprises an allele-specific motif such that the peptide will bind the MHC allele (HLA in human) and be capable of inducing a CTL (cytoxic T-lymphocytes) response. Thus, immunogenic peptides are capable of binding to an appropriate class I or II MHC molecule and inducing a cytotoxic T cell or T helper cell response against the antigen from which the immunogenic peptide is derived.

Alternatively, amino acid sequence variants of the peptide can be prepared by mutations in the DNA, which encodes the peptide, or by peptide synthesis.

At the genetic level, these variants ordinarily are prepared by site-directed mutagenesis of nucleotides in the DNA encoding the peptide molecule, thereby producing DNA encoding the variant, and thereafter expressing the DNA in recombinant cell culture. The variants typically exhibit the same qualitative biological activity as the nonvariant peptide.

T-lymphocytes recognize antigen in association with Class I or Class II MHC molecules in the form of a peptide fragment bound to an MHC molecule. The degree of peptide binding to a given MHC allele is based on amino acids at particular positions within the peptide (Parker et al. (1992) Journal of Immunology 149:3580; Kubo, et al. (1994) Journal of Immunology 52:3913-3924; Ruppert J. et al. (1993) Cell 74:929-937; Falk et al. (1991) Nature 351:290-296). The peptides of the present invention are useful as an epitope for immunogenic response (see more detailed description below).

In human, MHC is called HLA, wherein class I molecules are encoded by the HLA-A, B, and C loci. HLA-A and B antigens are expressed at the cell surface at approximately equal densities, whereas the expression of HLA-C is significantly lower (about 10-fold lower). Each of these loci has a number of alleles. MHC class II molecules are encoded by three pairs of MHC II alpha- and beta-chain genes, called HLA DR, -DP, and -DQ in human. In many haplotypes the HLA-DR cluster contains an extra beta-chain gene whose product can pair with the DR alpha chain. Each MHC class I and II molecule binds a different rage of peptides. The present of several loci means that any one individual is equipped to present a much broader ranger of different peptides than if only one MHC protein of each class were expressed at the cell surface. The peptide binding motifs of the present invention are designed to be specific for each allelic subtype.

The peptides of the present invention are used for treatment of the kidney diseases. Treatment involves administration of the protective composition after the appearance of the disease.

The present invention is also applied to prevent and suppress the disease. It is not always possible to distinguish between "preventing" and "suppressing" since the ultimate inductive event or events may be unknown, latent, or the patient is not ascertained until well after the occurrence of the event or events. Therefore, it is common to use the term "prophylaxis" as distinct from "treatment" to encompass both "preventing" and "suppressing" as defined herein. The term "protection," as used herein, is meant to include "prophylaxis."

The peptides are used for treating T cell-mediated pathology. The term "T cell-mediated pathology" refers to any condition in which an inappropriate T cell response is a component of the pathology. The term is intended to encompass both T cell mediated kidney diseases and diseases resulting from unregulated clonal T cell replication.

Therefore, the present invention relates to peptides or modified peptides derived from the protein sequences of the KCAT proteins that differentially expressed in the kidney diseases. By way of example, modification may include substitution, deletion or addition of an amino acid in the given immunogenic peptide sequence or mutation of existing amino acids within the given immunogenic peptide sequence, or derivatization of existing amino acids within the given immunogenic peptide sequence. Any amino acid comprising the immunogenic peptide sequence may be modified in accordance with this invention. In one aspect, at least one amino acid is substituted or replaced within the given immunogenic peptide sequence. Any amino acid may be used to substitute or replace a given amino acid within the immunogenic peptide sequence. Modified peptides are intended to include any immunogenic peptide obtained from differentially expressed proteins, which has been modified and exhibits enhanced binding to the MHC molecule with which it associates when presented to the T-cell. These modified peptides may be synthetically or recombinantly produced by conventional methods.

In another embodiment, the peptides of the present invention comprise, or consisting sequences of about 5-8, 8-10, 10-15 or 15-30 amino acids which are immunogenic, that is, capable of inducing an immune response when injected into a subject.

The recombinant or natural protein, peptides, or fragment thereof of KCAT, or modified peptides, may be used as a vaccine either prophylactically or therapeutically. When provided prophylactically the vaccine is provided in advance of any evidence of kidney diseases, particularly, cancer. The prophylactic administration of the kidney diseases vaccine should serve to prevent or attenuate kidney diseases, preferably cancer, in a mammal.

Preparation of Vaccine is Using Recombinant Protein or Peptide Expression vectors comprising all or part of nucleic acid sequence of KCAT proteins encoding peptides. Examples of vectors that may be used in the aforementioned vaccines include, but are not limited to, defective retroviral vectors, adenoviral vectors vaccinia viral vectors, fowl pox viral vectors, or other viral vectors (Mulligan, R. C., (1993) Science 260:926-932). The viral vectors carrying all or part of nucleic sequence of SEQ ID NOS: 2737-5164 can be introduced into a mammal either prior to any evidence of kidney diseases or to mediate regression of the disease in a mammal afflicted with kidney diseases. Examples of methods for administering the viral vector into the mammals include, but are not limited to, exposure of cells to the virus ex vivo, or injection of the retrovirus or a producer cell line of the virus into the affected tissue or intravenous administration of the virus. Alternatively the viral vector carrying all or part of the KCAT nucleic acid sequence that encode peptides may be administered locally by direct injection into the cancer lesion or topical application in a pharmaceutically acceptable carrier. The quantity of viral vector, carrying all or part of the KCAT nucleic acid sequence, to be administered is based on the titer of virus particles. A preferred range of the immunogen to be administered may be about 106 to about 1011 virus particles per mammal, preferably a human. After immunization the efficacy of the vaccine can be assessed by production of antibodies or immune cells that recognize the antigen, as assessed by specific lytic activity or specific cytokine production or by tumor regression. One skilled in the art would know the conventional methods to assess the aforementioned parameters. If the mammal to be immunized is already afflicted with cancer, the vaccine can be administered in conjunction with other therapeutic treatments. Examples of other therapeutic treatments includes, but are not limited to, adoptive T cell immunotherapy, coadministration of cytokines or other therapeutic drugs for cancer.

Alternatively all or parts thereof of a substantially or partially purified the KCAT protein or their peptides may be administered as a vaccine in a pharmaceutically acceptable carrier. Ranges of the protein that may be administered are about 0.001 to about 100 mg per patient, preferred doses are about 0.01 to about 100 mg per patient. In a preferred embodiment, the peptides or modified peptides thereof is administered therapeutically or prophylactically to a mammal in need of such treatment. The peptide may be synthetically or recombinantly produced. Immunization is repeated as necessary, until a sufficient titer of anti-immunogen antibody or immune cells has been obtained.

In yet another alternative embodiment a viral vector, such as a retroviral vector, can be introduced into mammalian cells. Examples of mammalian cells into which the retroviral vector can be introduced include, but are not limited to, primary mammalian cultures or continuous mammalian cultures, COS cells, NIH3T3, or 293 cells (ATTC #CRL 1573), dendritic cells. The means by which the vector carrying the gene may be introduced into a cell includes, but is not limited to, microinjection, electroporation, transfection or transfection using DEAE dextran, lipofection, calcium phosphate or other procedures known to one skilled in the art (Sambrook et al. (EDS) (2001) in "Molecular Cloning. A laboratory manual", Cold Spring Harbor Press Plainview, N.Y.).

The vaccine formulation of the present invention comprises an immunogen that induces an immune response directed against the cancer associated antigens such as the KCATs, and in nonhuman primates and finally in humans. The safety of the immunization procedures is determined by looking for the effect of immunization on the general health of the immunized animal (weight change, fever, appetite behavior etc.) and looking for pathological changes on autopsies. After initial testing in animals, cancer patients can be tested. Conventional methods would be used to evaluate the immune response of the patient to determine the efficiency of the vaccine.

Measurement of candidate disease tumor antigen or vaccine expression in patients is the first step of the present invention. Subsequent steps will focus on measuring immune responses to these candidate antigens or vaccine. Sera from disease patients, particularly cancer patients, and healthy donors will be screened for antibodies to the candidate antigens as well as for levels of circulating tumor derived antigens. antigen. The vaccine formulations may be evaluated first in animal models, initially rodents In one embodiment mammals, preferably human, at high risk for kidney diseases, particularly cancer, are prophylactically treated with the vaccines of this invention. Examples of such mammals include, but are not limited to, humans with a family history of kidney diseases, humans with a history of kidney diseases, particular cancer, or humans afflicted with kidney cancer previously resected and therefore at risk for reoccurrence. When provided therapeutically, the vaccine is provided to enhance the patient's own immune response to the diseased antigen present on the kidney diseases or advanced stage of kidney diseases. The vaccine, which acts as an immunogen, may be a cell, cell lysate from cells transfected with a recombinant expression vector, cell lysates from cells transfected with a recombinant expression vector, or a culture supernatant containing the expressed protein. Alternatively, the immunogen is a partially or substantially purified recombinant protein, peptide or analog thereof or modified peptides or analogs thereof. The proteins or peptides may be conjugated with lipoprotein or administered in liposomal form or with adjuvant.

While it is possible for the immunogen to be administered in a pure or substantially pure form, it is preferable to present it as a pharmaceutical composition, formulation or preparation. The formulations of the present invention are described in the previous section.

Vaccination can be conducted by conventional methods. For example, the immunogen can be used in a suitable diluent such as saline or water, or complete or incomplete adjuvants. Further, the immunogen may or may not be bound to a carrier to make the protein immunogenic. Examples of such carrier molecules include but are not limited to bovine serum albumin (BSA), keyhole limpet hemocyanin (KLH), tetanus toxoid, and the like. The immunogen also may be coupled with lipoproteins or administered in liposomal form or with adjuvants. The immunogen can be administered by any route appropriate for antibody production such as intravenous, intraperitoneal, intramuscular, subcutaneous, and the like. The immunogen may be administered once or at periodic intervals until a significant titer of anti-KCAT immune cells or anti-KCAT antibody is produced. The presence of anti-KCAT immune cells may be assessed by measuring the frequency of precursor CTL (cytoxic T-lymphocytes) against KCAT antigen prior to and after immunization by a CTL precursor analysis assay (Coulie, P. et al., (1992) International Journal Of Cancer 50:289-297). The antibody may be detected in the serum using the immunoassay described above.

The safety of the immunization procedures is determined by looking for the effect of immunization on the general health of the immunized animal (weight change, fever, appetite behavior etc.) and looking for pathological changes on autopsies. After initial testing in animals, kidney diseases patients can be tested. Conventional methods would be used to evaluate the immune response of the patient to determine the efficiency of the vaccine.

In yet another embodiment of this invention all, part, or parts of the KCAT proteins or peptides or fragments thereof, or modified peptides, may be exposed to dendritic cells cultured in vitro. The cultured dendritic cells provide a means of producing T-cell dependent antigens comprised of dendritic cell modified antigen or dendritic cells pulsed with antigen, in which the antigen is processed and expressed on the antigen activated dendritic cell. The KCAT antigen activated dendritic cells or processed dendritic cell antigens may be used as immunogens for vaccines or for the treatment of kidney diseases, particularly kidney cancer. The dendritic cells should be exposed to antigen for sufficient time to allow the antigens to be internalized and presented on the dendritic cells surface. The resulting dendritic cells or the dendritic cell process antigens can than be administered to an individual in need of therapy. Such methods are described in Steinman et al. (WO93/208185) and in Banchereau et al. (EPO Application 0563485A1).

In yet another aspect of this invention T-cells isolated from individuals can be exposed to the KCAT proteins, peptides or fragment thereof, or modified peptides in vitro and then administered to a patient in need of such treatment in a therapeutically effective amount. Examples of where T-lymphocytes can be isolated include but are not limited to, peripheral blood cells lymphocytes (PBL), lymph nodes, or tumor infiltrating lymphocytes (TIL). Such lymphocytes can be isolated from the individual to be treated or from a donor by methods known in the art and cultured in vitro (Kawakami, Y. et al. (1989) J. Immunol. 142: 2453-3461). Lymphocytes are cultured in media such as RPMI or RPMI 1640 or AIM V for 1-10 weeks. Viability is assessed by trypan blue dye exclusion assay. Examples of how these sensitized T-cells can be administered to the mammal include but are not limited to, intravenously, intraperitoneally or intralesionally. Parameters that may be assessed to determine the efficacy of these sensitized T-lymphocytes include, but are not limited to, production of immune cells in the mammal being treated or tumor regression. Conventional methods are used to assess these parameters. Such treatment can be given in conjunction with cytokines or gene modified cells (Rosenberg, S. A. et al. (1992) Human Gene Therapy, 3: 75-90; Rosenberg, S. A. et al. (1992) Human Gene Therapy, 3: 57-73).

The present invention is further described by the following example. The example is provided solely to illustrate the invention by reference to specific embodiments. This exemplification, while illustrating certain aspects of the invention, does not offer the limitations or circumscribe the scope of the disclosed invention.

All examples outlined here were carried out using standard techniques, which are well known and routine to those of skill in the art. Routine molecular biology techniques of the following example can be carried out as described in standard laboratory manuals, such as Sambrook et al., Molecular Cloning: A laboratory Manual, 3rd. ed., Cold Spring Harbor Laboratory Press, Cold Spring Harbor, N.Y., (2001).

WORKING EXAMPLES

1. Kidney Cancer Cell Line Model System; Tissue Processing

Cell Culture

Kidney cancer cell lines were obtained from ATTC. Cancer cell lines Caki-1, Caki-2, ACHN, A-704, 769-9, 786-0 were cultured in the appropriate tissue culture medium (Minimum essential medium with 2 mM L-glutamine and Earle's BSS adjusted to contain 1.5 g/L sodium bicarbonate, 0.1 mM non-essential amino acids, and 1.0 mM sodium pyruvate, 90%; fetal bovine serum, 10% or RPMI 1640 medium with 2 mM L-glutamine adjusted to contain 1.5 g/L sodium bicarbonate, 4.5 g/L glucose, 10 mM HEPES, and 1.0 mM sodium pyruvate, 90%; fetal bovine serum, 10% or McCoy's 5a medium with 1.5 mM L-glutamine, 90%; fetal bovine serum, 10%). Non-cancer kidney cell lines CCD-1103 and CCD-1105 were obtained from ATCC. These cell lines were cultured in Ham's F 12K medium with 2 mM L-glutamine adjusted to contain 1.5 g/L sodium bicarbonate, 90%; fetal bovine serum, 10%. Primary normal human renal epithelial cells (HRE) were obtained from Cambrex. HRE cells were cultured in REGM Renal Epithelial Cell Medium. All cells were passaged twice a week. Prior to harvesting for experiments, cells were cultured for 48 hours until 75-80% confluency and disassociated with versene.

Tissue Processing

Kidney tumor and adjacent normal tissue was collected under IRB protocol approval. Tissue specimens arrived within 12-16 hours post-surgery in Renal Transport Buffer. Renal Transport Buffer was composed of A-52 Medium supplemented with 5 ug/ml Vancomycin, 10 ug/mL Metronidazole, 10 ug/ml Cefotaxime, 250 ug/ml Fungizone (Amphotericin B), 2 mM L-glutamine, 1× Protease Inhibitor Cocktail (Sigma), and 1× Penicillin/Streptomycin.

Upon arrival, tissues were imaged, weighed, and dimensions measured (L×W×H). Tumor tissue was dissected when necessary for removal of fat and necrotic regions. Tissue was re-weighed post-dissection. Tissue was minced into 1 mm pieces and incubated for 1 hrs in 37° waterbath with agitation in Tissue Digestion Medium (collagenase type I, Hyaluronidase, DNase I and Dispase). Cells were passed through a 40-mesh sieve to obtain a single cell suspension. The cell suspension was passed through a 200-mesh sieve and cell number and cell viability was determined by PI exclusion. Red blood cells were lysed using PharMLyse (BD Biosciences) by incubating for 30 seconds with gentle agitation. Cells number and viability were recalculated by PI exclusion. Cells at a total cell number greater than $20\times10^6$ were sorted using a high-speed sorter (MoFlo Cytomation) for epithelial cells (EpCAM positive).

Cell Sorting

Cells were resuspended in Sort Staining Buffer at a concentration of $2\times10^7$ cell/ml and labeled for 30 minutes with 20 ul/$10^6$ cells of anti-CD45-FITC (cat# 347463 BD Biosciences) and 5 ul/106 cells of anti-EpCAM-APC (cat# 347200 BD Biosciences). Cells were pelleted for 5 minutes at 300 g and washed once with Sort Staining Buffer. Cells were resuspended in Sort Staining Buffer at a concentration of $1\times10^7$ cells/ml. Cells were sorted using a high speed cell sorter with a 70 uM nozzle and a 60 psi sheath pressure at a sort speed of approximately $2\times10^7$ cells per hour.

Periodate Oxidation

Cell Lines

Cells are cultured for 48 hours until 75-80% confluency as determined by microscopy. One T150 flask was set aside for flow cytometry QC analysis and the remaining cells disassociated with versene. Cells were washed twice with PBS and cell viability and cell number determined by PI exclusion (GUAVA). Cell viability was at a minimum of 85% viable and cell number at a minimum of $1\times10^7$ cells. Cells were pelleted at 300 g for 5 minutes and treated with 1 mM sodium-meta periodate in D-PBS for 10 minutes at 4° C. protected from light. Cells were washed 3 times with D-PBS and cell viability determined. Cells were lysed in 2-3 ml of Protein Lysis Buffer (0.125 mM Tris-HCl pH 7.4, 150 mM NaCl, 2% SDS, 5 mM EDTA, 0.5% NP-40, 0.25% sodium deoxycholate) by vortexing and incubation at 4° C. for 1 hour. Cells were sheared through an 18-gauge needle 15 times and protein concentration determined using a DC protein assay (BioRad). 5 mg protein aliquots from cell lines were processed for cell surface protein capture. Each cell line was analyzed in triplicate for ICAT comparison with the reference non-cancer kidney cell line CCD-1103.

Tissue

Cells isolated from kidney tissue that were enriched for epithelial cells by high-speed flow cytometry sorting were analyzed by PI for cell viability and cell number and treated with 1 mM sodium-meta periodate for 10 minutes at 4° C. protected from light. Cells were washed 3 times with D-PBS and lysed in approximately 200 ul of Protein Lysis Buffer (0.125 mM Tris-HCl pH 7.4, 150 mM NaCl, 2% SDS, 5 mM EDTA, 0.5% NP-40, 0.25% sodium deoxycholate). Cells were vortexed, incubated in lysis buffer for 30 minutes at 4° C., and sheared 15 times through an 18-gauge needle prior to protein concentration determined using a DC protein assay (BioRad). 1 mg protein aliquots were processed for cell surface protein capture.

Flow Cytometry Analysis

One T150 flask of cells was incubated with 1:100 dilution of BrdU in tissue culture media for 2-4 hours (BrdU Flow Kit cat# 559619 BD Biosciences). Cells were washed 3 times with PBS and disassociated from the flask with versene. Cells number and viability determined by PI exclusion (GUAVA). A minimum of $1.5\times10^6$ cells was used for this experiment. Cells were washed once with Flow Staining Buffer (0.5% BSA, 0.05% $NaN_3$ in D-PBS). Cells were incubated with 400 ul of Cytofix/Cytoperm Buffer (BrdU Flow Kit BD Biosciences) for 15-30 minutes at 4° C. Cells were washed once with Flow Staining Buffer and resuspended in 400 ul Cytoperm Plus Buffer (BrdU Flow Kit BD Biosciences). Cells were incubated for 10 minutes at 4° C. and washed once with 1× Perm/Wash Buffer (BrdU Flow Kit BD Biosciences). Cells were incubated for 1 hour at 37° C. protected from light in DNAse solution (BrdU Flow Kit BD Biosciences). Cells were washed once with 1× Perm/Wash Buffer and incubated for 20 minutes at room temperature with anti-BrdU FITC conjugated antibody (BrdU Flow Kit BD Biosciences), PE-conjugated active caspase 3 (BD Biosciences cat# 550821), PE-conjugated cytokeratin antibody (BD Biosciences), PE-conjugated EGF-R, APC-conjugated CD44 (BD Biosciences), PE mouse IgG2B, and APC mouse IgG2β isotype controls. Cells were washed once with 1× Perm/Wash Buffer and resuspended in DAPI for LSR flow cytometry analysis.

2. Cloning and Expression of Target Proteins cDNA Retrieval

Peptide sequences were searched by BlastP against the Celera Discovery System (CDS) and public database to identify the corresponding full-length open reading frames (ORFs). Each ORF sequence was then searched by BlastN against the Celera in-house human cDNA clone collection. For each sequence of interest, up to three clones are pulled and streaked onto LB/Ampicillin (100 ug/ml) plates. Plasmid DNA is isolated using Qiagen spin mini-prep kit and verified by restriction digest. Subsequently, the isolated plasmid DNA is sequence verified against the ORF reference sequence. Sequencing reactions are carried out using Applied Biosystems BigDye Terminator kit followed by ethanol precipitation. Sequence data is collected using the Applied Biosystems 3100 Genetic Analyzer and analyzed by alignment to the reference sequence using the Clone Manager alignment tool.

PCR

PCR primers are designed to amplify the full-length ORF as well as any regions of the ORF that are interest for expression (antigenic or hydrophilic regions as determined by the Clone Manager sequence analysis tool). Primers also contain 5' and 3' overhangs to facilitate cloning (see below). PCR reactions contain 2.5 units Platinum Taq DNA Polymerase High Fidelity (Invitrogen), 50 ng cDNA plasmid template, 1 uM forward and reverse primers, 800 uM dNTP cocktail (Applied Biosystems) and 2 mM MgSO4. After 20-30 cycles (94° C. for 30 seconds, 55° C. for 1 minutes and 73° C. for 2 minutes), product is verified and quantitated by agarose gel electrophoresis.

Construction of Entry Clones

PCR products are cloned into an entry vector for use with the Gateway recombination based cloning system (Invitrogen). These vectors include pDonr221, pDonr201, pEntr/D-TOPO or pEntr/SD/D-TOPO and are used as described in the cloning methods below.

TOPO Cloning into pEntr/D-TOPO or pEntr/SD/D-TOPO

For cloning using this method, the forward PCR primer contained a 5' overhang containing the sequence "CACC". PCR products are generated as described above and cloned into the entry vector using the Invitrogen TOPO cloning kit. Reactions are typically carried out at room temperature for 10 minutes and subsequently transformed into TOP10 chemically competent cells (Invitrogen, CA). Candidate clones are picked, plasmid DNA is prepared using Qiagen spin mini-prep kit and screened using restriction digest. Inserts are subsequently sequence verified as described above.

Gateway Cloning into pDonr201 or pDonr221

For cloning using this method,
PCR primers contained the following overhangs:

Forward 5'overhang:5'-GGGGACAAGTTTGTACAAA AAAGCAGGCTTC-3'

Reverse 5' overhang:5'-GGGGACCACTTTGTACAAGA AAGCTGGGT-3'

PCR products are generated as described above. ORFs are recombined into the entry vector using the Invitrogen Gateway BP Clonase enzyme mix. Reactions are typically carried out at 25° C. for 1 hour, treated with Proteinase K at 37° C. for 10 minutes and transformed into Library Efficiency DH5α chemically competent cells (Invitrogen, CA). Candidate clones are picked, plasmid DNA is prepared using Qiagen spin mini-prep kit and screened using restriction digest. Inserts are subsequently sequence verified as described above.

Construction of Expression Clones

ORFs are transferred from the entry construct into a series of expression vectors using the Gateway LR Clonase enzyme mix. Reactions are typically carried out for 1 hour at 25° C., treated with Proteinase K at 37° C. for 10 minutes and subsequently transformed into Library Efficiency DH5a chemically competent cells (Invitrogen). Candidate clones are picked, plasmid DNA is prepared using Qiagen spin mini-prep kit and screened using restriction digest. Expression vectors include but are not limited to pDest14, pDest15, pDest17, pDest10, pDest10 and pDest20. These vectors allow expression in systems such as E. coli and recombinant baculovirus. Other vectors not listed here allow expression in yeast, mammalian cells, or in vitro.

Expression of Recombinant Proteins in E. coli

Constructs are transformed into one or more of the following host strains: BL21 SI, BL21 AI, (Invitrogen); Origami B (DE3), Origami B (DE3) pLysS, Rosetta (DE3), Rosetta (DE3) pLysS, Rosetta-Gami (DE3), Rosetta-Gami (DE3) pLysS, or Rosetta-Gami B (DE3) pLysS (Novagen). The transformants are grown in LB with or without NaCl and with appropriate antibiotics, at temperatures in the range of 20-37° C., with aeration. Expression is induced with the addition of IPTG (0.03-0.3 mM) or NaCl (75-300 mM) when the cells are in mid-log growth. Growth is continued for one to 24 hours post-induction. Cells are harvested by centrifugation in a Sorvall RC-3C centrifuge in a H6000A rotor for 10 minutes at 3000 rpm, at 4° C. Cell pellets are stored at −80° C.

Expression of Recombinant Proteins Using Baculovirus

Recombinant proteins are expressed using baculovirus in Sf21 fall army worm ovarian cells. Recombinant baculoviruses are prepared using the Bac-to-Bac system (Invitrogen) per the manufacturer's instructions. Proteins are expressed on the large scale in Sf900II serum-free medium (Invitrogen) in a 10L bioreactor tank (27° C., 130 rpm, 50% dissolved oxygen for 48 hours).

3. Recombinant Protein Purification

Recombinant proteins are purified from E. coli and/or insect cells using a variety of standard chromatography methods. Briefly, cells are lysed using sonication or detergents. The insoluble material is pelleted by centrifugation at 10,000×g for 15 minutes. The supernatant is applied to an appropriate affinity column, e.g. His-tagged proteins are separated using a pre-packed chelating sepharose column (Pharmacia) or GST-tagged proteins are separated using a glutathione sepharose column (Pharmacia). After using the affinity column, proteins are further separated using various techniques, such as ion exchange chromatography (columns from Pharmacia) to separate on the basis of electrical charge or size exclusion chromatography (columns from Tosohaas) to separate on the basis of molecular weight, size and shape.

Expression and purification of the protein are also achieved using either a mammalian cell expression system or an insect cell expression system. The pUB6/V5-His vector system (Invitrogen, CA) is used to express GSCC in CHO cells. The vector contains the selectable bsd gene, multiple cloning sites, the promoter/enhancer sequence from the human ubiquitin C gene, a C-terminal V5 epitope for antibody detection with anti-V5 antibodies, and a C-terminal polyhistidine (6.times.His) sequence for rapid purification on PROBOND resin (Invitrogen, CA). Transformed cells are selected on media containing blasticidin.

Spodoptera frugiperda (Sf9) insect cells are infected with recombinant Autographica californica nuclear polyhedrosis virus (baculovirus). The polyhedrin gene is replaced with the cDNA by homologous recombination and the polyhedrin promoter drives cDNA transcription. The protein is synthesized as a fusion protein with 6×his which enables purification as described above. Purified protein is used in the following activity and to make antibodies

4. Chemical Synthesis of Peptides

Proteins or portions thereof may be produced not only by recombinant methods, but also by using chemical methods well known in the art. Solid phase peptide synthesis may be carried out in a batchwise or continuous flow process which sequentially adds alpha.-amino- and side chain-protected amino acid residues to an insoluble polymeric support via a linker group. A linker group such as methylamine-derivatized polyethylene glycol is attached to poly(styrene-co-divinylbenzene) to form the support resin. The amino acid residues are N-a-protected by acid labile Boc (t-butyloxycarbonyl) or base-labile Fmoc (9-fluorenylmethoxycarbonyl). The carboxyl group of the protected amino acid is coupled to the amine of the linker group to anchor the residue to the solid phase support resin. Trifluoroacetic acid or piperidine are used to remove the protecting group in the case of Boc or Fmoc, respectively. Each additional amino acid is added to the anchored residue using a coupling agent or pre-activated amino acid derivative, and the resin is washed. The full length peptide is synthesized by sequential deprotection, coupling of derivitized amino acids, and washing with dichloromethane and/or N,N-dimethylformamide. The peptide is cleaved between the peptide carboxy terminus and the linker group to yield a peptide acid or amide. (Novabiochem 1997/98 Catalog and Peptide Synthesis Handbook, San Diego Calif. pp. S1-S20). Automated synthesis may also be carried out on machines such as the 431A peptide synthesizer (ABI). A protein or portion thereof may be purified by preparative high performance liquid chromatography and its composition confirmed by amino acid analysis or by sequencing (Creighton (1984) Proteins, Structures and Molecular Properties, W H Freeman, New York N.Y.).

5. Antibody Development

Polyclonal Antibody Preparations:

Polyclonal antibodies against recombinant proteins are raised in rabbits (Green Mountain Antibodies, Burlington, Vt.). Briefly, two New Zealand rabbits are immunized with 0.1 mg of antigen in complete Freund's adjuvant. Subsequent immunizations are carried out using 0.05 mg of antigen in incomplete Freund's adjuvant at days 14, 21 and 49. Bleeds are collected and screened for recognition of the antigen by solid phase ELISA and western blot analysis. The IgG fraction is separated by centrifugation at 20,000×g for 20 minutes followed by a 50% ammonium sulfate cut. The pelleted protein is resuspended in 5 mM Tris and separated by ion exchange chromatography. Fractions are pooled based on IgG content. Antigen-specific antibody is affinity purified using Pierce AminoLink resin coupled to the appropriate antigen.

Isolation of Antibody Fragments Directed Against KCATs from A Library of scFvs

Naturally occurring V-genes isolated from human PBLs are constructed into a library of antibody fragments which contain reactivities against KCAT to which the donor may or may not have been exposed (see e.g., U.S. Pat. No. 5,885,793 incorporated herein by reference in its entirety).

Rescue of the Library: A library of scFvs is constructed from the RNA of human PBLs as described in PCT publication WO 92/01047. To rescue phage displaying antibody fragments, approximately 109 E. coli harboring the phagemid are used to inoculate 50 ml of 2×TY containing 1% glucose and 100.mu.g/ml of ampicillin (2.times.TY-AMP-GLU) and grown to an O.D. of 0.8 with shaking. Five ml of this culture is used to innoculate 50 ml of 2.times.TY-AMP-GLU, 2×108 TU of delta gene 3 helper (M13 delta gene III, see PCT publication WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100.mu.g/ml ampicillin and 50 ug/ml kanamycin and grown overnight. Phage are prepared as described in PCT publication WO 92/01047.

M13 delta gene III is prepared as follows: M13 delta gene III helper phage does not encode gene III protein, hence the phage(mid) displaying antibody fragments have a greater avidity of binding to antigen. Infectious M13 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8,400 r.p.m. for 10 min), resuspended in 300 ml 2×TY broth containing 100.mu.g ampicillin/ml and 25.mu.g kanamycin/ml (2×TY-AMP-KAN) and grown overnight, shaking at 37° C. Phagre particles are purified and concentrated from the culture medium by two PEG-precipitations (Sambrook et al., 2001), resuspended in 2 ml PBS and passed through a 0.45.mu.m filter (Minisart NML; Sartorius) to give a final concentration of approximately 1013 transducing units/ml (ampicillin-resistant clones).

Panning of the Library: Immunotubes (Nunc) are coated overnight in PBS with 4 ml of either 100.mu.g/ml or 10.mu.g/ml of a polypeptide of the present invention. Tubes are blocked with 2% Marvel-PBS for 2 hours at 37° C. and then washed 3 times in PBS. Approximately 1013 TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phages are then used to infect 10 ml of mid-log E. coli TG1 by incubating eluted phage with bacteria for 30 minutes at 37° C. The E. coli are then plated on TYE plates containing 1% glucose and 100.mu.g/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders: Eluted phage from the 3rd and 4th rounds of selection are used to infect *E. coli* HB 2151 and soluble scFv is produced (Marks, et al., 1991) from single colonies for assay. ELISAs are performed with microtitre plates coated with either 10.mu.g/ml of the polypeptide of the present invention in 50 mM bicarbonate pH 9.6. Clones positive in ELISA are further characterized by PCR fingerprinting (see, e.g., PCT publication WO 92/01047) and then by sequencing.

Monoclonal Antibody Generation i) Materials:

1) Complete Media No Sera (CMNS) for washing of the myeloma and spleen cells; Hybridoma medium CM-HAT {Cell Mab (BD), 10% FBS (or HS); 5% Origen HCF (hybridoma cloning factor) containing 4 mM L-glutamine and antibiotics} to be used for plating hybridomas after the fusion.

2) Hybridoma medium CM-HT (NO AMINOPTERIN) (Cell Mab (BD), 10% FBS 5% Origen HCF containing 4 mM L-glutamine and antibiotics) to be used for fusion maintenance are stored in the refrigerator at 4-6° C. The fusions are fed on days 4, 8, and 12, and subsequent passages. Inactivated and pre-filtered commercial Fetal Bovine serum (FBS) or Horse Serum (HS) are thawed and stored in the refrigerator at 4° C. and must be pretested for myeloma growth from single cells.

3) The L-glntamine (200 mM, 100× solution), which is stored at −20° C. freezer, is thawed and warmed until completely in solution. The L-glntamin is dispensed into media to supplement growth. L-glntamin is added to 2 mM for myelomas, and 4 mM for hybridoma media. Further the Penicillin, Streptomycin, Amphotericin (antibacterial-antifungal stored at −20° C.) is thawed and added to Cell Mab Media to 1%.

4) Myeloma growth media is Cell Mab Media (Cell Mab Media, Quantum Yield from BD is stored in the refrigerator at 4° C. in the dark) which are added L-glntamine to 2 mM and antibiotic/antimycotic solution to 1% and is called CMNS.

5) 1 bottle of PEG 1500 in Hepes (Roche, N.J.)

6) 8-Azaguanine is stored as the dried powder supplied by SIGMA at −70° C. until needed. Reconstitute 1 vial/500 ml of media and add entire contents to 500 ml media (eg. 2 vials/liter).

7) Myeloma Media is CM which has 10% FBS (or HS) and 8-Aza (1×) stored in the refrigerator at 4° C.

8) Clonal cell medium D (Stemcell, Vancouver) contains HAT and methyl cellulose for semi-solid direct cloning from the fusion. This comes in 90 ml bottles with a CoA and must be "melted at 37° C. in a waterbath in the morning of the day of the fusion. Loosen the cap and leave in CO2 incubator to sufficiently gas the medium D and bring the pH down.

9) Hybridoma supplements HT [hypoxanthine, thymidine] are to be used in medium for the section of hybridomas and maintenance of hybridomas through the cloning stages respectively.

10) Origen HCF can be obtained directly from Igen and is a cell supernatant produced from a macrophage-like cell-line. It can be thawed and aliqouted to 15 ml tubes at 5 ml per tube and stored frozen at −20° C. Positive Hybridomas are fed HCF through the first subcloning and are gradually weaned. It is not necessary to continue to supplement unless you have a particularly difficult hybridoma clone. This and other additives have been shown to be more effective in promoting new hybridoma growth than conventional feeder layers.

ii) Procedure

To generate monoclonal antibodies, mice are immunized with 5-50 ug of antigen either intra-peritoneally (i.p.) or by intravenous injection in the tail vein (i.v.). Typically, the antigen used is a recombinant protein that is generated as described above. The primary immunization takes place 2 months prior to the harvesting of splenocytes from the mouse and the immunization is typically boosted by i.v. injection of 5-50 ug of antigen every two weeks. At least one week prior to expected fusion date, a fresh vial of myeloma cells is thawed and cultured. Several flasks at different densities are maintained in order that a culture at the optimum density is ensured at the time of fusion. The optimum density is determined to be $3-6 \times 10^5$ cells/ml. Two to five days before the scheduled fusion, a final immunization is administered of ~5 ug of antigen in PBS i.p. or i.v.

Myeloma cells are washed with 30 ml serum free media by centrifugation at 500 g at 4° C. for 5 minutes. Viable cell density is determined in resuspended cells using hemocytometry and vital stains. Cells resuspended in complete growth medium are stored at 37° C. during the preparation of splenocytes. Meanwhile, to test aminopterin sensitivity, $1 \times 10^6$ myeloma cells are transferred to a 15 ml conical tube and centrifuged at 500 g at 4° C. for 5 minutes. The resulting pellet is resuspended in 15 ml of HAT media and cells plated at 2 drops/well on a 96 well plate.

To prepare splenocytes from immunized mice, the animals are euthanised and submerged in 70% ETOH. Under sterile conditions, the spleen is surgically removed and placed in 10 ml of RPMI medium supplemented with 20% fetal calf serum in a Petri dish. Cells are extricated from the spleen by infusing the organ with medium >50 times using a 21 g syringe.

Cells are harvested and washed by centrifugation (at 500 g at 4° C. for 5 minutes) with 30 ml of medium. Cells are resuspended in 10 ml of medium and the density of viable cells determined by hemocytometry using vital stains. The splenocytes are mixed with myeloma cells at a ratio of 5:1 (spleen cells: myeloma cells). Both the myeloma and spleen cells are washed 2 more times with 30 ml of RPMI-CMNS. Spin at 800 rpm for 12 minutes.

Supernatant is removed and cells are resuspended in 5 ml of RPMI-CMNS and are pooled to fill volume to 30 ml and spin down as before. Then, the pellet is broken up by gently tapping on the flow hood surface and resuspended in 1 ml of BMB REG1500 (prewarmed to 37° C.) dropwise with 1 cc needle over 1 minute.

RPMI-CMNS to the PEG cells and RPMI-CMNS are added to slowly dilute out the PEG. Cells are centrifuged and diluted in 5 ml of Complete media and 95 ml of Clonacell Medium D (HAT) media (with 5 ml of HCF). The cells are plated out 10 ml per small petri plate.

Myeloma/HAT control. P is prepared as follows: dilute about 1000 P3X63 Ag8.653 myeloma cells into 1 ml of mediu D and transfer into a single well of a 24 well plate. Plates are placed in incubator, with two plates inside of a large petri plate, with an additional petri plate full of distilled water, for 10-18 days under 5% CO2 overlay at 37° C. Clones are picked from semisolid agarose into 96 well plates containing 150-200 ul of CM-HT. Supernatants are screened 4 days later in ELISA, and positive clones are moved up to 24 well plates. Heavy growth will require changing of the media at day 8 (+/−150 ml). One should further decrease the HCF to 0.5% (gradually—2%, then 1%, then 0.5%) in the cloning plates.

For further references see Kohler G, and C. Milstein Continuous cultures of fused cells secreting antibody of predefined specificity. 1975. Nature 256: 495-497; Lane, R. D. A short duration polyethylene glycol fusion technique for increasing production of monoclonal antibody-secreting hybridomas. 1985. J. Immunol. Meth. 81:223-228;

Harlow, E. and D. Lane. Antibodies: A laboratory manual-.Cold Spring Harbour Laboratory Press. 1988; Kubitz, D. The Scripps Research Institute. La Jolla. Personal Communication; Zhong, G., Berry, J. D., and Choukri, S. (1996) Mapping epitopes of *Chlamydia trachomatis* neutralizing monoclonal antibodies using phage random peptide libraries. J. Indust. Microbiol. Biotech. 19, 71-76; Berry, J. D., Licea, A., Popkov, M., Cortez, X., Fuller, R., Elia, M., Kerwin, L., and C.F. Barbas III. (2003) Rapid monoclonal antibody generation via dendritic cell targeting in vivo. Hybridoma and Hybridomics 22 (1), 23-31.

6. mRNA Expression

Validation in Tissues by Taqman

Expression of mRNA is quantitated by RT-PCR using TaqMan® technology. The Taqman system couples a 5' fluorogenic nuclease assay with PCR for real time quantitation. A probe is used to monitor the formation of the amplification product.

Total RNA is isolated from cancer model cell lines using the RNEasy kit® (Qiagen) per manufacturer's instructions and included DNase treatment. Normal human tissue RNAs are acquired from commercial vendors (Ambion, Austin, Tex.; Stratagene, La Jolla, Calif., BioChain Institute, Newington, N.H.) as were RNAs from matched disease/normal tissues.

Target transcript sequences are identified for the differentially expressed peptides by searching the BlastP database. TaqMan assays (PCR primer/probe set) specific for those transcripts are identified by searching the Celera Discovery System™ (CDS) database. The assays are designed to span exon-exon borders and do not amplify genomic DNA.

The TaqMan primers and probe sequences are as designed by Applied Biosystems (AB) as part of the Assays on Demand™ product line or by custom design through the AB Assays by Design$^{SM}$ service.

RT-PCR is accomplished using AmpliTaqGold and MultiScribe reverse transcriptase in the One Step RT-PCR Master Mix reagent kit (AB) according to the manufacturer's instructions. Probe and primer concentrations are 250 nM and 900 nM, respectively, in a 15 µl reaction. For each experiment, a master mix of the above components is made and aliquoted into each optical reaction well. Eight nanograms of total RNA is the template. Each sample is assayed in triplicate. Quantitative RT-PCR is performed using the ABI Prism® 7900HT Sequence Detection System (SDS). Cycling parameters follow: 48° C. for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values are used to quantitate the relative amount of starting template in the reaction. The $C_T$ values for each set of three reactions are averaged for all subsequent calculations Data are analyzed for fold difference in expression using an endogenous control for normalization and is expressed relative to a normal tissue or normal cell line reference. The choice of endogenous control is determined empirically by testing various candidates against the cell line and tissue RNA panels and selecting the one with the least variation in expression. Relative changes in expression are quantitated using the $2^{-\Delta\Delta C_T}$ Method. Livak, K. J. and Schmittgen, T. D. (2001) Methods 25: 402-408; User bulletin #2: ABI Prism 7700 Sequence Detection System.

Validation by Tissue Flow Cytometry Analysis

Post tissue processing, cells are sorted by flow cytometry known in the art to enrich for epithelial cells. Alternatively, cells isolated from kidney tissue are stained directly with EpCAM (for epithelial cells) and the specific antibody to KCAT. Cell numbers and viability are determined by PI exclusion (GUAVA) for cells isolated from both normal and tumor kidney tissue. A minimum of $0.5 \times 10^6$ cells are used for each analysis. Cells are washed once with Flow Staining Buffer (0.5% BSA, 0.05% NaN3 in D-PBS). To the cells, 20 ul of each antibody for KCAT are added. An additional 5 ul of EpCAM antibody conjugated to APC were added when unsorted cells are used in the experiment. Cells are incubated with antibodies for 30 minutes at 4° C. Cells are washed once with Flow Staining Buffer and either analyzed immediately on the LSR flow cytometry apparatus or fixed in 1% formaldehyde and store at 4° C. until LSR analysis. The antibodies used to detect KCAT targets are all purchased by BD Biosciences and PE-conjugated. The isotype control antibody used for these experiments is PE-conjugated mouse IgG1k.

7. Detection and Diagnosis of KCAT by Liquid Chromatography and Mass Spectrometry (LC/MS)

The proteins from cells can be prepared by reduction, alkylation and cysteine-containing peptide enrichment of concentrated conditioned media.

The differential expression of proteins in disease and healthy samples are quantitated using Liquid Chromatography Mass Spectrometry. The LC/MS spectra from disease and healthy (control) samples are collected and processed using the following steps:

The raw scans from the LC/MS instrument are subjected to peak detection and noise reduction software. Filtered peak lists are then used to detect 'features' corresponding to specific peptides from the original sample(s). Features are characterized by their mass/charge, charge, retention time, isotope pattern and intensity.

Similar experiments are repeated in order to increase the confidence in detection of a peptide. These multiple acquisitions are computationally aggregated into one experiment. The intensity of a peptide present in both healthy and disease samples is used to calculate the differential expression, or relative abundance, of the peptide. The intensity of a peptide found exclusively in one sample is used to calculate a theoretical expression ratio for that peptide (singleton). Expression ratios are calculated for each peptide of each replicate of the experiment Statistical tests are performed to assess the robustness of the data and select statistically significant differentials. To assess general quality of the data, a) ensured that similar features are detected in all replicates of the experiment; b) number of matched ions between replicates; c) calculated the overall pair wise intensity correlations between LC/MS maps of process replicates to ensure that the expression ratios for peptides are reproducible across the multiple replicates; d) aggregated multiple experiments in order to compare the expression ratio of a peptide in multiple diseases or disease samples.

8. Expression Validation by IHC in Tissue Sections

Tissue Sections

Paraffin embedded, fixed tissue sections are obtained from a panel of normal tissues (Adrenal, Bladder, Lymphocytes, Bone Marrow, Breast, Cerebellum, Cerebral cortex, Colon, Endothelium, Eye, Fallopian tube, Small Intestine, Heart, Kidney [glomerulus, tubule], Liver, Lung, Testes and Thyroid) as well as 30 tumor samples with matched normal adjacent tissues from kidney, pancreas, lung, colon, prostate, ovarian and breast. In addition, other tissues are selected for testing such as bladder, hepatocellular, pharyngeal and gastric tumor tissues. Replicate sections are also obtained from numerous tumor types (Kidney Cancer, Bladder Cancer, Lung Cancer, Breast Cancer, Melanoma, Colon Cancer, Non-Hodgkins Lymphoma, Endometrial Cancer, Ovarian Cancer, Head and Neck Cancer, Prostate Cancer, Leukemia [ALL and CML] and Rectal Cancer). Sections are stained with hemotoxylin and eosin and histologically examined to ensure adequate representation of cell types in each tissue section.

An identical set of tissues will be obtained from frozen sections and are used in those instances where it is not possible to generate antibodies that are suitable for fixed sections. Frozen tissues do not require an antigen retrieval step.

Paraffin Fixed Tissue Sections

Hemotoxylin and Eosin staining of paraffin embedded, fixed tissue sections.

Sections are deparaffinized in 3 changes of xylene or xylene substitute for 2-5 minutes each. Sections are rinsed in 2 changes of absolute alcohol for 1-2 minutes each, in 95% alcohol for 1 minute, followed by 80% alcohol for 1 minute. Slides are washed well in running water and stained in Gill solution 3 hemotoxylin for 3 to 5 minutes. Following a vigorous wash in running water for 1 minute, sections are stained in Scott's solution for 2 minutes. Sections are washed for 1 min in running water then conterstained in Eosin solution for 2-3 minutes depending upon development of desired staining intensity. Following a brief wash in 95% alcohol, sections are dehydrated in three changes of absolute alcohol for 1 minute each and three changes of xylene or xylene substitute for 1-2 minutes each. Slides are coverslipped and stored for analysis.

Optimisation of Antibody Staining

For each antibody, a positive and negative control sample are generated using data from the ICAT analysis of the kidney cancer cell lines/tissues. Cells are selected that are known to express low levels of a particular target as determined from the ICAT data. This cell line is the reference normal control. Similarly, a kidney tumor line is selected that is determined to overexpress the target is selected.

Antigen Retrieval

Sections are deparaffinized and rehydrated by washing 3 times for 5 minutes in xylene; two times for 5 minutes in 100% ethanol; two times for 5 minutes in 95% ethanol; and once for 5 minutes in 80% ethanol. Sections are then placed in endogenous blocking solution (methanol+2% hydrogen peroxide) and incubated for 20 minutes at room temperature. Sections are rinsed twice for 5 minutes each in deionized water and twice for 5 minutes in phosphate buffered saline (PBS), pH 7.4. Alternatively, where necessary sections are deparrafinized by High Energy Antigen Retrieval as follows: sections are washed three times for 5 minutes in xylene; two times for 5 minutes in 100% ethanol; two times for 5 minutes in 95% ethanol; and once for 5 minutes in 80% ethanol. Sections are placed in a Coplin jar with dilute antigen retrieval solution (10 mM citrate acid, pH 6). The Coplin jar containing slides is placed in a vessel filled with water and microwaved on high for 2-3 minutes (700 watt oven). Following cooling for 2-3 minutes, steps 3 and 4 are repeated four times (depending on tissue), followed by cooling for 20 minutes at room temperature. Sections are then rinsed in deionized water, two times for 5 minutes, placed in modified endogenous oxidation blocking solution (PBS+2% hydrogen peroxide).and rinsed for 5 minutes in PBS.

Blocking and Staining

Sections are blocked with PBS/1% bovine serum albumin (PBA) for 1 hour at room temperature followed by incubation in normal serum diluted in PBA (2%) for 30 minutes at room temperature to reduce non-specific binding of antibody. Incubations are performed in a sealed humidity chamber to prevent air-drying of the tissue sections. (The choice of blocking serum is the same as the species of the biotinylated secondary antibody). Excess antibody is gently removed by shaking and sections covered with primary antibody diluted in PBA and incubated either at room temperature for 1 hour or overnight at 4° C. (Care is taken that the sections do not touch during incubation).Sections are rinsed twice for 5 minutes in PBS, shaking gently. Excess PBS is removed by gently shaking. The sections are covered with diluted biotinylated secondary antibody in PBA and incubated for 30 minutes to 1 hour at room temperature in the humidity chamber. If using a monoclonal primary antibody, addition of 2% rat serum is used to decrease the background on rat tissue sections. Following incubation, sections are rinsed twice for 5 minutes in PBS, shaking gently. Excess PBS is removed and sections incubated for 1 hour at room temperature in Vectastain ABC reagent (as per kit instructions). The lid of the humidity chamber is secured during all incunations to ensure a moist environment. Sections are rinsed twice for 5 minutes in PBS, shaking gently.

Develop and Counterstain

Sections are incubated for 2 minutes in peroxidase substrate solution that is made up immediately prior to use as follows:
  10 mg diaminobenzidine (DAB) dissolved in 10 ml 50 mM sodium phosphate buffer, pH 7.4.
  12.5 microliters 3% $CoCl_2/NiCl_2$ in deionized water
  1.25 microliters hydrogen peroxide Slides are rinsed well three times for 10 min in deionized water and counterstained with 0.01% Light Green acidified with 0.01% acetic acid for 1-2 minutes depending on intensity of counterstain desired.

Slides are rinsed three times for 5 minutes with deionized water and dehydrated two times for 2 minutes in 95% ethanol; two times for 2 minutes in 100% ethanol; and two times for 2 minutes in xylene. Stained slides are mounted for visualization by microscopy.

9. IHC Staining of Frozen Tissue Sections

Fresh tissues are embedded carefully in OCT in plastic mold, without trapping air bubbles surrounding the tissue. Tissues are frozen by setting the mold on top of liquid nitrogen until 70-80% of the block turns white at which point the mold is placed on dry ice. The frozen blocks were stored at −80° C. Blocks are sectioned with a cryostat with care taken to avoid warming to greater than −10° C. Initially, the block is equilibrated in the cryostat for about 5 minutes and 6-10 mm sections are cut sequentially. Sections are allowed to dry for at least 30 minutes at room temperature. Following drying, tissues are stored at 4° C. for short term and −80° C. for long term storage.)

Sections are fixed by immersing in acetone jar for 1-2 minutes at room temperature, followed by drying at room temp. Primary antibody is added (diluted in 0.05 M Tris-saline [0.05 M Tris, 0.15 M NaCl, pH 7.4], 2.5% serum) directly to the sections by covering the section dropwise to cover the tissue entirely. Binding is carried out by incubation a chamber for 1 hour at room temperature. Without letting the sections dry out, the secondary antibody (diluted in Tris-saline/2.5% serum) is added in a similar manner to the primary and incubated as before (at least 45 minutes).

Following incubation, the sections are washed gently in Tris-saline for 3-5 minutes and then in Tris-saline/2.5% serum for another 3-5 minutes. If a biotinylated primary antibody is used, in place of the secondary antibody incubation, slides are covered with 100 ul of diluted alkaline phosphatase conjugated streptavidin, incubated for 30 minutes at room temperature and washed as above. Sections are incubated with alkaline phosphatase substrate (1 mg/ml Fast Violet; 0.2 mg/ml Napthol AS-MX phosphate in Tris-Saline pH 8.5) for 10-20 minutes until the desired positive staining is achieved at which point the reaction is stopped by washing twice with Tris-saline. Slides are counter-stained with Mayer's hematoxylin for 30 seconds and washed with tap water for 2-5 minutes. Sections are mounted with Mount coverslips and mounting media.

10. Assay for Antibody Dependent Cellular Cytotoxicity

Cultured tumor cells are labeled with 100 µCi 51Cr for 1 hour; Livingston, P. O., Zhang, S., Adluri, S., Yao, T.-J., Graeber, L., Ragupathi, G., Helling, F., & Fleischer, M. (1997). Cancer Immunol. Immunother. 43, 324-330. After being washed three times with culture medium, cells are resuspended at $10^5$/ml, and 100 µl/well are plated onto 96-well round-bottom plates. A range of antibody concentrations are applied to the wells, including an isotype control together with donor peripheral blood mononuclear cells that are plated at a 100:1 and 50:1 ratio. After an 18-h incubation at 37° C., supernatant (30 µl/well) is harvested and transferred onto Lumaplate 96 (Packard), dried, and read in a Packard Top-Count NXT γ counter. Each measurement is carried out in triplicate. Spontaneous release is determined by cpm of tumor cells incubated with medium and maximum release by cpm of tumor cells plus 1% Triton X-100 (Sigma). Specific lysis is defined as: % specific lysis=[(experimental release-spontaneous release)/(maximum release-spontaneous release)]×100. The percent ADCC is expressed as peak specific lysis postimmune subtracted by preimmune percent specific lysis. A doubling of the ADCC to >20% is considered significant.

11. Assay for Complement Dependent Cytotoxicity

Chromium release assays to assess complement-mediated cytotoxicity are performed for each patient at various time points; Dickler, M. N., Ragupathi, G., Liu, N. X., Musselli, C., Martino, D. J., Miller, V. A., Kris, M. G., Brezicka, F. T., Livingston, P. O. & Grant, S.C. (1999) Clin. Cancer Res. 5, 2773-2779. Cultured tumor cells are washed in FCS-free media two times, resuspended in 500 µl of media, and incubated with 100 µCi $^{51}$Cr per 10 million cells for 2 h at 37° C. The cells are then shaken every 15 min for 2 h, washed 3 times in media to achieve a concentration of approximately 20,000 cells/well, and then plated in round-bottom plates. The plates contain either 50 µl cells plus 50 µl monoclonal antibody, 50 µl cells plus serum (pre- and posttherapy), or 50 µl cells plus mouse serum as a control. The plates are incubated in a cold room on a shaker for 45 min. Human complement of a 1:5 dilution (resuspended in 1 ml of ice-cold water and diluted with 3% human serum albumin) is added to each well at a volume of 100 µl. Control wells include those for maximum release of isotope in 10% Triton X-100 (Sigma) and for spontaneous release in the absence of complement with medium alone. The plates are incubated for 2 h at 37° C., centrifuged for 3 min, and then 100 µl of supernatant is removed for radioactivity counting. The percentage of specific lysis is calculated as follows: % cytotoxicity=[(experimental release-spontaneous release)/(maximum release-spontaneous release)]×100. A doubling of the CDC to >20% is considered significant.

12. In Vitro Assays in Cell Lines; RNAi

Lipofectamine is purchased from Invitrogen (Carlsbad, Calif.) and GeneSilencer from Gene Therapy Systems (San Diego, Calif.). Synthetic siRNA oligonucleotides are from Dharmacon (Lafayette, Colo.), Qiagen (Valencia, Calif.) or Ambion (Austin, Tex.) RNeasy 96 Kit is purchased from Qiagen (Valencia, Calif.). Apop-one homogeneous caspase-3/7 kit and CellTiter 96 AQueous One Solution Cell Proliferation Assay are both purchased from Promega (Madison, Wis.). Alamar Blue proliferation assay can be purchased from Biosource (Camarillo, Calif.). Function blocking antibodies are purchased from Chemicon (Temecula, Calif.), Biotrend (Cologne, Germany) or Alexis Corporation (San Diego, Calif.). Cell invasion assay kits from purchased from Chemicon (Temecula, Calif.). RiboGreen RNA Quantitation Kit is purchased from Molecular probes (Eugene, Oreg.).

RNAi

RNAi is performed by using Smartpools (Dharmacon), 4-for Silencing siRNA duplexes (Qiagen) or scrambled negative control siRNA (Ambion). Transient transfections are carried out in triplicate by using either Lipofectamine 2000 from Invitrogen (Carlsbad, Calif.) or by using GeneSilencer from Gene Therapy Systems (San Diego, Calif.) in methods described below. 1 to 4 days after transfections, total RNA is isolated by using the RNeasy 96 Kit (Qiagen) according to manufacturer's instructions and expression of mRNA is quantitated by using TaqMan technology. Protein expression levels are examined by flow cytometry and apoptosis and proliferation assays are performed daily using Apop-one homogeneous caspase-3/7 kit and CellTiter 96 AQueous One Solution Cell Proliferation Assay (see protocols below).

i) RNAi Transfections—Lipofectamine 2000

Transient transfections are carried out on sub-confluent kidney cancer cell lines as previously described. Elbashir, S. M. et al. (2001) Nature 411: 494-498; Caplen, N. J. et al. (2001) Proc Natl Acad Sci USA 98: 9742-9747; Sharp, P.A. (2001) Genes and Development 15: 485-490. Synthetic RNA to gene of interest or scrambled negative control siRNA is transfected using lipofectamine according to manufacturer's instructions. Cells are plated in 96 well plates in antibiotics free medium. The next day, the transfection reagent and siRNA are prepared for transfections as follows: Each 0.1-1 ul of lipofectamine 2000 and 10-150 mM siRNA are resuspended 25 ul serum-free media and incubated at room temperature for 5 minutes. After incubation, the diluted siRNA and the lipofectamine 2000 are combined and incubated for 20 minutes at room temperature. The cells are then washed and the combined siRNA-Lipofectamine 2000 reagent added. After further 4 hours incubation, 50 ul serum containing medium is added to each well. 1 and 4 days after transfection, expression of mRNA is quantitated by RT-PCR using TaqMan technology and protein expression levels are examined by flow cytometry. Apoptosis and proliferation assays are performed daily using Apop-one homogeneous caspase-3/7 kit and CellTiter 96 AQueous One Solution Cell Proliferation Assay (see protocols below).

ii) RNAi Transfections—GeneSilencer

Transient transfections are carried out on sub-confluent kidney cancer cell lines as previously described. Elbashir, S. M. et al. (2001) Nature 411: 494-498; Caplen, N. J. et al. (2001) Proc Natl Acad Sci USA 98: 9742-9747; Sharp, P.A. (2001) Genes and Development 15: 485-490. Synthetic RNA to gene of interest or scrambled negative control siRNA is transfected using GeneSilencer according to manufacturer's instructions. Cells are plated in 96 well plates in antibiotics free medium. The next day, the transfection reagent and the synthetic siRNA are prepared for transfections as follows: predetermined amount of Gene Silencer is diluted in serum-free media to a final volume of 20 ul per well. After resuspending 10-150 mM siRNA in 20 ul serum-free media, the reagents are combined and incubated at room temperature for 5-20 minutes. After incubation, the siRNA-Gene Silencer reagent is added to each well and incubated in a 37° C. incubator for 4 hours before an equal volume of serum containing media is added back to the cultured cells. The cells are then incubated for 1 to 4 days before mRNA, protein expression and effects on apoptosis and proliferation are examined.

Testing of Function Blocking Antibodies

Sub-confluent kidney cancer cell lines are serum-staved overnight. The next day, serum-containing media is added back to the cells in the presence of 5-50 ng/ml of function blocking antibodies. After 2 or 5 days incubation at 37° C. 5% $CO_2$, antibody binding is examined by flow cytometry and apoptosis and proliferation are examined by using protocols described below.

Apoptosis

Apoptosis assay is performed by using the Apop-one homogeneous caspase-3/7 kit from Promega. Briefly, the caspase-3/7 substrate is thawed to room temperature and diluted 1:100 with buffer. The diluted substrate is then added 1:1 to cells, control or blank. The plates are then placed on a plate shaker for 30 minutes to 18 hours at 300-500 rpm. The fluorescence of each well is then measured at using an excitation wavelength of 485+/−20 nm and an emission wavelength of 530+/−25 nm.

Proliferation—MTS

Proliferation assay is performed by using the CellTiter 96 AQueous One Solution Cell Proliferation Assay kit from Promega. 20 ul of CellTiter 96 AQueous One Solution is added to 100 ul of culture medium. The plates are then incubated for 1-4 hours at 37° C. in a humidified 5% $CO_2$ incubator. After incubation, the change in absorbance is read at 490 nm.

Proliferation—Alamar Blue

Proliferation assay is performed by using the Alamar Blue assay from Biosource. 10 ul of Alamar Blue reagent is added to 100 ul of cells in culture medium. The plates are then incubated for 1-4 hours at 37° C. in a humidified 5% $CO_2$ incubator. After incubation, the change in fluorescence is measured at using an excitation wavelength of 530 nm and an emission wavelength of 595 nm.

Cell Invasion

Cell invasion assay is performed by using the 96 well cell invasion assay kit available from Chemicon. After the cell invasion chamber plates are adjusted to room temperature, 10 ul serum-free media is added to the interior of the inserts. 1-2 hours later, cell suspensions of $1 \times 10^6$ cells/ml are prepared. Media is then carefully removed from the inserts and 100 ul of prepared cells are added into the insert +/−0 to 50 ng function blocking antibodies. The cells are pre-incubated for 15 minutes at 37° C. before 150 ul of media containing 10% FBS is added to the lower chamber. The cells are then incubated for 48 hours at 37° C. After incubation, the cells from the top side of the insert are discarded and the invasion chamber plates are then placed on a new 96-well feeder tray containing 150 ul of pre-warmed cell detachment solution in the wells. The plates are incubated for 30 minutes at 37° C. and are periodically shaken. Lysis buffer/dye solution (4 ul CyQuant Dye/300 ul 4× lysis buffer) is prepared and added to each well of dissociation buffer/cells on feeder tray. The plates are incubated for 15 minutes at room temperature before 150 ul is transferred to a new 96-well plate. Fluorescence of invading cells is then read at 480 excitation and 520 emission.

Receptor Internalization

For quantification of receptor internalization, ELISA assays are performed essentially as described by Daunt et al. Daunt, D. A., Hurtz, C., Hein, L., Kallio, J., Feng, F., and Kobilka, B. K. (1997) Mol. Pharmacol. 51, 711-720. The cell lines are plated at $6 \times 10^5$ cells per in a 24-well tissue culture dishes that have previously been coated with 0.1 mg/ml poly-L-lysine. The next day, the cells are washed once with PBS and incubated in DMEM at 37° C. for several minutes. Agonist to the cell surface target of interest is then added at a pre-determined concentration in prewarmed DMEM to the wells. The cells are then incubated for various times at 37° C. and reactions are stopped by removing the media and fixing the cells in 3.7% formaldehyde/TBS for 5 min at room temperature. The cells are then washed three times with TBS and nonspecific binding blocked with TBS containing 1% BSA for 45 min at room temperature. The first antibody is added at a pre-determined dilution in TBS/BSA for 1 h at room temperature. Three washes with TBS followed, and cells are briefly reblocked for 15 min at room temperature. Incubation with goat anti-mouse conjugated alkaline phosphatase (Bio-Rad) diluted 1:1000 in TBS/BSA is carried out for 1 h at room temperature. The cells are washed three times with TBS and a colorimetric alkaline phosphatase substrate is added. When the adequate color change is reached, 100-μl samples are taken for colorimetric readings.

mRNA Expression

Expression of mRNA is quantitated by RT-PCR using Taq-Man® technology. Total RNA is isolated from cancer model cell lines using the RNEasy 96 kit (Qiagen) per manufacturer's instructions and included DNase treatment. Target transcript sequences are identified for the differentially expressed peptides by searching the BlastP database. TaqMan assays (PCR primer/probe set) specific for those transcripts are identified by searching the Celera Discovery System™ (CDS) database. The assays are designed to span exon-exon borders and do not amplify genomic DNA. The TaqMan primers and probe sequences are as designed by Applied Biosystems (AB) as part of the Assays on Demand™ product line or by custom design through the AB Assays by Design$^{SM}$ service. RT-PCR is accomplished using AmpliTaqGold and MultiScribe reverse transcriptase in the One Step RT-PCR Master Mix reagent kit (AB) according to the manufacturers instructions. Probe and primer concentrations are 900 nM and 250 nM, respectively, in a 25 μl reaction. For each experiment, a master mix of the above components is made and aliquoted into each optical reaction well. 5 ul of total RNA is the template. Each sample is assayed in triplicate. Quantitative RT-PCR is performed using the ABI Prism® 7900HT Sequence Detection System (SDS). Cycling parameters follow: 48° C. for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values are used to quantitate the relative amount of starting template in the reaction. The $C_T$ values for each set of three reactions are averaged for all subsequent calculations.

Total RNA is quantitated by using RiboGreen RNA Quantitation Kit according to manufacturer's instructions and the % mRNA expression is calculated using total RNA for normalization. % knockdown is then calculated relative to the no addition control.

13. In Vivo Studies by Using Antibodies

Treatment of Kidney Cancer Cells with Monoclonal Antibodies.

Kidney cancer cells are seeded at a density of $4 \times 10^4$ cells per well in 96-well microtiter plates and allowed to adhere for 2 hours. The cells are then treated with different concentrations of anti-KCAT monoclonal antibody (Mab) or irrelevant isotype matched (anti-rHuIFN-.gamma. Mab) at 0.05, 0.5 or 5.0 mug/ml. After a 72 hour incubation, the cell monolayers are stained with crystal violet dye for determination of relative percent viability (RPV) compared to control (untreated) cells. Each treatment group consists of replicates. Cell growth inhibition is monitored.

Treatment of NIH 3T3 Cells Overexpression KCAT Protein with Monoclonal Antibodies.

NIH 3T3 expressing KCAT protein are treated with different concentrations of anti-KCAT MAbs. Cell growth inhibition is monitored.

In vivo treatment of NIH 3T3 cells overexpressing KCAT with anti-KCAT monoclonal antibodies.

NIH 3T3 cells transfected with either a KCAT expression plasmid or the neo-DHFR vector are injected into nu/nu (athymic) mice subcutaneously at a dose of 106 cells in 0.1 ml of phosphate-buffered saline. On days 0, 1, 5 and every 4 days thereafter, 100 mug (0.1 ml in PBS) of either an irrelevant or anti-KCAT monoclonal antibody of the IG2A subclass is injected intraperitoneally. Tumor occurrence and size are monitored for 1 month period of treatment.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention, which are obvious to those skilled in the field of molecular biology or related fields, are intended to be within the scope of the following claims.

TABLE 2

| Sample ID Number | Sample | Type | Lymph Nodes | Distant Metastasis | Extent of Invasion | AJCC Stage |
|---|---|---|---|---|---|---|
| 600-A125 | Fresh Tissue | Clear cell carcinoma | N0 | MX | T1a | |
| 37031A1 | Fresh Tissue | Clear cell carcinoma | NX | MX | T1 | NA |
| 22792A1 | Fresh Tissue | Clear cell carcinoma | NX | M0 | T3a | |

---

SEQUENCE LISTING (6044 sequences)

SEQ ID NO: 1 - protein, 552 aa, Homo sapiens
MAECNLVAILISSIDNPLDKNLDNGGNSCLDFRPLNSFSQPQVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 2 - protein, 511 aa, Homo sapiens
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 3 - protein, 511 aa, Homo sapiens; identical to SEQ ID NO: 2

SEQ ID NO: 4 - protein, 511 aa, Homo sapiens; identical to SEQ ID NO: 2

SEQ ID NO: 5 - protein, 798 aa, Homo sapiens [sequence omitted]

SEQ ID NO: 6 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 7 - protein, 798 aa, Homo sapiens; identical to SEQ ID NO: 6

SEQ ID NO: 8 - protein, 798 aa, Homo sapiens; identical to SEQ ID NO: 6

SEQ ID NO: 9 - protein, 819 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTPGVQWCDISSLQPLTSRFQQFSCLSLPSTWDYRVKILFIRVP

SEQ ID NO: 10 - protein, 789 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTVSYKTSKKQSGL

SEQ ID NO: 11 - protein, 801 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 12 - protein, 819 aa, Homo sapiens; identical to SEQ ID NO: 9

SEQ ID NO: 13 - protein, 801 aa, Homo sapiens; identical to SEQ ID NO: 11

SEQ ID NO: 14 - protein, 219 aa, Homo sapiens
MNYNIIFKIIKHFKNYTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 15 - protein, 819 aa, Homo sapiens; identical to SEQ ID NO: 9

SEQ ID NO: 16 - protein, 801 aa, Homo sapiens; identical to SEQ ID NO: 11

SEQ ID NO: 17 - protein, 798 aa, Homo sapiens; identical to SEQ ID NO: 6

SEQ ID NO: 18 - protein, 825 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTSLSVAQPGVQWCDISSLQPLTSRFQQFSCLSLPSTWDYRVKILFIRVP

SEQ ID NO: 19 - protein, 798 aa, Homo sapiens; identical to SEQ ID NO: 6

SEQ ID NO: 20 - protein, 798 aa, Homo sapiens; identical to SEQ ID NO: 6

SEQ ID NO: 21 - protein, 789 aa, Homo sapiens; identical to SEQ ID NO: 10

SEQ ID NO: 22 - protein, 682 aa, Homo sapiens
MPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKVESRDKLPQPVQPDPVSHCKEKDVDDCWFYFTYSVNGNNEVMVHVVENPVSHWSRHHSNCSWCGCWNCSYWPCITADMEAFNDNS

SEQ ID NO: 23 - protein, 825 aa, Homo sapiens; identical to SEQ ID NO: 18

SEQ ID NO: 24 - protein, 825 aa, Homo sapiens; identical to SEQ ID NO: 18

SEQ ID NO: 25 - protein, 63 aa, Homo sapiens
MCQAWGNPLPELKCLKDGTFPLPIGESVTVTRDLEGTYLCRARSTQGEVTRKPPGMRLSSSLW

SEQ ID NO: 26 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTREVTVNVLSPRYEIVIITVVAAAVIMGTAGLSTYLYNRQRKIKKYRLQQAQKGTPMKPNTQATPP

SEQ ID NO: 27 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 28 - protein, 1675 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 29 - protein, 1674 aa, Homo sapiens
AQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 30 - protein, 1682 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDAIKEKVDKLDASESLRKEEEQATETQPIVYGQPQLMLTAGPSVAVPPQAPFGYGYTAPPYGQPQPGFGYSM

SEQ ID NO: 31 - protein, 1639 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGNLSL

SEQ ID NO: 32 - protein, 1675 aa, Homo sapiens; identical to SEQ ID NO: 28

SEQ ID NO: 33 - protein, 1675 aa, Homo sapiens; identical to SEQ ID NO: 28

SEQ ID NO: 34 - protein, 1679 aa, Homo sapiens
MAQILPIRFQEHLQLQNLGINPANIGFSTLTMESDKFICIREKVGEQAQVVIIDMNDPSNPIRRPISADSAIMNPASKVIALKGIKESGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 35 - protein, 393 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMLGGMGLCKYHFSVFFLS

SEQ ID NO: 36 - protein, 449 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 37 - protein, 449 aa, Homo sapiens; identical to SEQ ID NO: 36

SEQ ID NO: 38 - protein, 449 aa, Homo sapiens; identical to SEQ ID NO: 36

SEQ ID NO: 39 - protein, 448 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 40 - protein, 543 aa, Homo sapiens
SSFSYEPYYSTSYKRRYVETPRVHISVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATTNEKQALRGEREEGLEETLRNLQARYEEEVLSREDAEGRLMERRKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQTEVEETIEASKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 41 - protein, 543 aa, Homo sapiens
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 42 - protein, 544 aa, Homo sapiens
MSSFSYEPYYSTSYKRRYVETPRVHISVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATTNEKQALRGEREEGLEETLRNLQARYEEEVLSREDAEGRLMERRKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQTEVEETIEASKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 43 - protein, 543 aa, Homo sapiens; identical to SEQ ID NO: 41

SEQ ID NO: 44 - protein, 543 aa, Homo sapiens; identical to SEQ ID NO: 41

SEQ ID NO: 45 - protein, 504 aa, Homo sapiens [sequence omitted]

SEQ ID NO: 46 - protein, 543 aa, Homo sapiens; identical to SEQ ID NO: 41

SEQ ID NO: 47 - protein, 180 aa, Homo sapiens
MIEKAKGETAYLPCKFTLSPEDQGPLDIEWLISPADNQKVDQVIILYSGDKNYDDYYPDLKGRVHFKSNDLKSGDASINVTNFQLSDIGTDQCKVKRAPGVANRKIQLVVLGKPSGTRCYVDGSEEIGSDFKLKCEPKEGSLPLQYEWQKLSDSQKMPTSWLAGKMCRLQRATRPLPEAT

SEQ ID NO: 48 - protein, 365 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 49 - protein, 252 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 50 - protein, 234 aa, Homo sapiens
MQIMLSPEDQGPLDIEWLISPADNQKMDQVMILYSGNKIYDDYYPELKGRVHFKRNDLKSGDASINVTNLQLSDIGTDQCKVKKAPGVANKIQLVVLVKPSGTRCYVDGSEEIGSDFKLKCEPKEGSLPLQYEWQKLSDSQKMPTSWEDVPPPKSRTSAARSCIGSNHSSLGSMSPSNMEGYSKTQYKQVPSEDFERTPQSPTLPPAKVAAPNLSRMGVIPVMIPAQSKDGSIV

SEQ ID NO: 51 - protein, 365 aa, Homo sapiens; identical to SEQ ID NO: 48

SEQ ID NO: 52 - protein, 179 aa, Homo sapiens
MQIMLSPEDQGPLDIEWLISPADNQKMDQVMILYSGNKIYDDYYPELKGRVHFKRNDLKSGDASINVTNLQLSDIGTDQCKVKKAPGVANKIQLVVLVKPSGTRCYVDGSEEIGSDFKLKCEPKEGSLPLQYEWQKLSDSQKMPTSWLAEMTSSVISVKKMLLLSTLGHTAVHQKRSGL

SEQ ID NO: 53 - protein, 179 aa, Homo sapiens; identical to SEQ ID NO: 52

SEQ ID NO: 54 - protein, 3623 aa, Homo sapiens [sequence omitted]

SEQ ID NO: 55 - protein, 712 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 56 - protein, 712 aa, Homo sapiens; identical to SEQ ID NO: 55

SEQ ID NO: 57 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 58 - protein, 769 aa, Homo sapiens; identical to SEQ ID NO: 57

SEQ ID NO: 59 - protein, 769 aa, Homo sapiens; identical to SEQ ID NO: 57

SEQ ID NO: 60 - protein, 769 aa, Homo sapiens; identical to SEQ ID NO: 57

SEQ ID NO: 61 - protein, 353 aa, Homo sapiens
GCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 62 - protein, 354 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 63 - protein, 354 aa, Homo sapiens; identical to SEQ ID NO: 62

SEQ ID NO: 64 - protein, 4127 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 65 - protein, 4097 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 66 - protein, 4033 aa, Homo sapiens
MGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 67 - protein, 4192 aa, Homo sapiens
GMAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDYRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVSLLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLNKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVTDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWMGLWESADRKHYIVRIYYTWLAAFHELIFLKHREMSFVLQFRSMSLNQDYDEMCMGIKDKVIVTSKIRGLKDRYPGLPKYVKNIICDQLSKHLQVL

SEQ ID NO: 68 - protein, 4128 aa, Homo sapiens [sequence omitted]

SEQ ID NO: 69 - protein, 4128 aa, Homo sapiens [sequence omitted]

SEQ ID NO: 70 - protein, 117 aa, Homo sapiens
CDKEFMWALKNGDLDEVKDYVAKGEDVNRTLEGGRKPLHYAADCGQLEILEFLLLKGADINAPDKHHITPLLSAVYEGHVSCVKLLLSKGADKTVKGPDGLTAFEATDNQAIKALLQ

SEQ ID NO: 71 - protein, 118 aa, Homo sapiens
MCDKEFMWALKNGDLDEVKDYVAKGEDVNRTLEGGRKPLHYAADCGQLEILEFLLLKGADINAPDKHHITPLLSAVYEGHVSCVKLLLSKGADKTVKGPDGLTAFEATDNQAIKALLQ

SEQ ID NO: 72 - protein, 118 aa, Homo sapiens; identical to SEQ ID NO: 71

SEQ ID NO: 73 - protein, 334 aa, Homo sapiens
GKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 74 - protein, 328 aa, Homo sapiens [sequence omitted]

SEQ ID NO: 75 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 76 - protein, 335 aa, Homo sapiens; identical to SEQ ID NO: 75

SEQ ID NO: 77 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 78 - protein, 474 aa, Homo sapiens
MLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 79 - protein, 766 aa, Homo sapiens; identical to SEQ ID NO: 77

SEQ ID NO: 80 - protein, 149 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSMYDRMRRGGDGYDGGMCI

SEQ ID NO: 81 - protein, 346 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 82 - protein, 346 aa, Homo sapiens; identical to SEQ ID NO: 81

SEQ ID NO: 83 - protein, 71 aa, Homo sapiens
MDWVMKHNGPNDASDGTVRLRGLPFGCSKEEIVQFFQGILRSSEVAGVKSKDFMIHQEDCWDSDRDHMIDQ

SEQ ID NO: 84 - protein, 71 aa, Homo sapiens; identical to SEQ ID NO: 83

SEQ ID NO: 85 - protein, 49 aa, Homo sapiens [sequence omitted]

SEQ ID NO: 86 - protein, 346 aa, Homo sapiens; identical to SEQ ID NO: 81

SEQ ID NO: 87 - protein, 71 aa, Homo sapiens; identical to SEQ ID NO: 83

SEQ ID NO: 88 - protein, 331 aa, Homo sapiens
MDWVMKHNGPNDASDGTVRLRGLPFGCSKEEIVQFFQGLEIVPNGITLTMDYQGRSTGEAFVQFASKEIAENALGKHKERIGHRYIEIFRSSRSEIKGFYDPPRRLLGQRPGPYDRPIGGRGGYYGAGRGSYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 89 - protein, 449 aa, Homo sapiens
MMLSTEGREGFVVKVRGLPWSCSADEVMRFFSDCKIQNGTSGIRFIYTREGRPSGEAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 90 - protein, 71 aa, Homo sapiens; identical to SEQ ID NO: 83

SEQ ID NO: 91 - protein, 449 aa, Homo sapiens; identical to SEQ ID NO: 89

SEQ ID NO: 92 - protein, 49 aa, Homo sapiens [sequence omitted]

SEQ ID NO: 93 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 94 - protein, 1669 aa, Homo sapiens; identical to SEQ ID NO: 93

SEQ ID NO: 95 - protein, 654 aa, Homo sapiens
MGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 96 - protein, 654 aa, Homo sapiens; identical to SEQ ID NO: 95

SEQ ID NO: 97 - protein, 570 aa, Homo sapiens [sequence omitted]

SEQ ID NO: 98 - protein, 570 aa, Homo sapiens
MAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 99 - protein, 412 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 100 - protein, 412 aa, Homo sapiens; identical to SEQ ID NO: 99

SEQ ID NO: 101 - protein, 412 aa, Homo sapiens; identical to SEQ ID NO: 99

SEQ ID NO: 102 - protein, 412 aa, Homo sapiens; identical to SEQ ID NO: 99

SEQ ID NO: 103 - protein, 955 aa, Homo sapiens [sequence omitted]

SEQ ID NO: 104 - protein, 977 aa, Homo sapiens [sequence omitted]

SEQ ID NO: 105 - protein, 977 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 106 - protein, 982 aa, Homo sapiens [sequence omitted]

SEQ ID NO: 107 - protein, 977 aa, Homo sapiens [sequence omitted]

SEQ ID NO: 108 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 109 - protein, 613 aa, Homo sapiens; identical to SEQ ID NO: 108

SEQ ID NO: 110 - protein, 609 aa, Homo sapiens
MFRCGGLAAGALKQKLVPLVRTVCVRSPRQRNRLPVVQSHHLGSPSRSLASTGASGKDGSNLVYFLIVGATVTGAGVYYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 111 - protein, 326 aa, Homo sapiens
MFRCGGLAAGALKQKLVPLVRTVCVRSPRQRNRLPARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 112 - protein, 609 aa, Homo sapiens; identical to SEQ ID NO: 110

SEQ ID NO: 113 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 114 - protein, 114 aa, Homo sapiens; identical to SEQ ID NO: 113

SEQ ID NO: 115 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 116 - protein, 1678 aa, Homo sapiens
MAVTTEKTRNSRPGTVAHPVIPALWEAEAGGSRGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 117 - protein, 2220 aa, Homo sapiens [sequence omitted]

SEQ ID NO: 118 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCNQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 119 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 120 - protein, 193 aa, Homo sapiens; identical to SEQ ID NO: 119

SEQ ID NO: 121 - protein, 928 aa, Homo sapiens
MGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 122 - protein, 928 aa, Homo sapiens; identical to SEQ ID NO: 121

SEQ ID NO: 123 - protein, 928 aa, Homo sapiens; identical to SEQ ID NO: 121

SEQ ID NO: 124 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 125 - protein, 1048 aa, Homo sapiens; identical to SEQ ID NO: 124

SEQ ID NO: 126 - protein, 1048 aa, Homo sapiens; identical to SEQ ID NO: 124

SEQ ID NO: 127 - protein, 1173 aa, Homo sapiens
EWRPRRLADALSLGLGPGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 128 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGHEHIPGSPYRVVVP

SEQ ID NO: 129 - protein, 2639 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 130 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 131 - protein, 331 aa, Homo sapiens
MWSRSQVYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLRSPASPASR

SEQ ID NO: 132 - protein, 311 aa, Homo sapiens
MHPDGGQLECLNLRPSGGLLRGAGAQRGWAHTDGPAKWGGPGLRLFLTDTICWFEEGPQAHSMTPCSSDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLRSPASPASR

SEQ ID NO: 133 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 134 - protein, 283 aa, Homo sapiens; identical to SEQ ID NO: 133

SEQ ID NO: 135 - protein, 283 aa, Homo sapiens; identical to SEQ ID NO: 133

SEQ ID NO: 136 - protein, 176 aa, Homo sapiens
EKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 137 - protein, 283 aa, Homo sapiens; identical to SEQ ID NO: 133

SEQ ID NO: 138 - protein, 283 aa, Homo sapiens; identical to SEQ ID NO: 133

SEQ ID NO: 139 - protein, 282 aa, Homo sapiens
AVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 140 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 141 - protein, 357 aa, Homo sapiens
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 142 - protein, 357 aa, Homo sapiens; identical to SEQ ID NO: 141

SEQ ID NO: 143 - protein, 339 aa, Homo sapiens; identical to SEQ ID NO: 140

SEQ ID NO: 144 - protein, 287 aa, Homo sapiens [sequence omitted]

SEQ ID NO: 145 - protein, 339 aa, Homo sapiens; identical to SEQ ID NO: 140

SEQ ID NO: 146 - protein, 339 aa, Homo sapiens; identical to SEQ ID NO: 140

SEQ ID NO: 147 - protein, 338 aa, Homo sapiens
STVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 148 - protein, 137 aa, Homo sapiens
MQCGLVGKIIKRFEQKGFRLVAMKFLPASEEHLKQHYIDLKDRPFFPGLVKYMNSGPVVAMVWEGLNVVKTGRVMLGETNPADSKPGTIRGDFCIQVGRNIIHGSDSVKSAEKEISLRFKPEELVDYKSCAHDWVYE

SEQ ID NO: 149 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 150 - protein, 114 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGR

SEQ ID NO: 151 - protein, 152 aa, Homo sapiens; identical to SEQ ID NO: 149

SEQ ID NO: 152 - protein, 152 aa, Homo sapiens; identical to SEQ ID NO: 149

SEQ ID NO: 153 - protein, 292 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 154 - protein, 137 aa, Homo sapiens; identical to SEQ ID NO: 148

SEQ ID NO: 155 - protein, 152 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 156 - protein, 152 aa, Homo sapiens; identical to SEQ ID NO: 155

SEQ ID NO: 157 - protein, 842 aa, Homo sapiens
MKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDTKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRGRSHLSGYDYVGFTNSYFGN

SEQ ID NO: 158 - protein, 2431 aa, Homo sapiens [sequence omitted]

SEQ ID NO: 159 - protein, 842 aa, Homo sapiens; identical to SEQ ID NO: 157

SEQ ID NO: 160 - protein, 602 aa, Homo sapiens
MKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRYS

SEQ ID NO: 161 - protein, 2418 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLDLLHLQLICRDTEDEEAWIQETEPSATSTYLGKDLIASKKLLNRHRVILENIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNARWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESRMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIERSCDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLHEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRVEAISLAMDYVGFTNSYFGN

SEQ ID NO: 162 - protein, 612 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 163 - protein, 612 aa, Homo sapiens; identical to SEQ ID NO: 162

SEQ ID NO: 164 - protein, 612 aa, Homo sapiens; identical to SEQ ID NO: 162

SEQ ID NO: 165 - protein, 612 aa, Homo sapiens; identical to SEQ ID NO: 162

SEQ ID NO: 166 - protein, 1508 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGECLHAWSQGSGGQCPV

SEQ ID NO: 167 - protein, 2337 aa, Homo sapiens [sequence omitted]

SEQ ID NO: 168 - protein, 2480 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQVRHREKPPTWGSWARTDQSHRRDQALALCSVTPLAQLWVPGLCSGRVQPTLGVGRKYPAHHVEFFSCLRSKGFEQKPVPLEHQGCGLKRDSLPRLGAAHRVGQPSLPATWVCATAECGGRGGDVRLWLAAPCKSVALPL

SEQ ID NO: 169 - protein, 385 aa, Homo sapiens [sequence omitted]

SEQ ID NO: 170 - protein, 420 aa, Homo sapiens
MPHSTALPEARPTKMSALGAVIALLLWGQLFAVDSGNDVTDIADDGCPKPPEIAHGYVEHSVRYQCKNYYKLRTEGDGVYTLNNEKQWINKAVGDKLPECEADDGCPKPPEIAHGYVEHSVRYQCKNYYKLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 171 - protein, 228 aa, Homo sapiens [sequence omitted]

SEQ ID NO: 172 - protein, 456 aa, Homo sapiens [sequence omitted]

SEQ ID NO: 173 - protein, 361 aa, Homo sapiens
MPHSTALPEARPTKMSALGAVIALLLWGQLFAVDSGNDVTDIADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 174 - protein, 362 aa, Homo sapiens
MPHSTALPEARPTKMSALGAVIALLLWGQLFAVDSGNDVTDIADDGCPKPPEIAHGYVEHSVRYQCKNYYKLRTEGDGVYTLNNEKQWINKAAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 175 - protein, 348 aa, Homo sapiens
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQDWVQKTIAEN

SEQ ID NO: 176 - protein, 406 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 177 - protein, 348 aa, Homo sapiens
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 178 - protein, 584 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVTEYLYANKMAFRYPEPEDKAKYVKERTWRSEYDSLLPDVYEWPESASSPPVITE

SEQ ID NO: 179 - protein, 748 aa, Homo sapiens [sequence omitted]

SEQ ID NO: 180 - protein, 479 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGYRIPIC

SEQ ID NO: 181 - protein, 304 aa, Homo sapiens
MGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGPDKPIDR

SEQ ID NO: 182 - protein, 584 aa, Homo sapiens; identical to SEQ ID NO: 178

SEQ ID NO: 183 - protein, 711 aa, Homo sapiens [sequence omitted]

SEQ ID NO: 184 - protein, 711 aa, Homo sapiens [sequence omitted]

SEQ ID NO: 185 - protein, 487 aa, Homo sapiens
TKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 186 - protein, 519 aa, Homo sapiens
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 187 - protein, 267 aa, Homo sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 188 - protein, 267 aa, Homo sapiens; identical to SEQ ID NO: 187

SEQ ID NO: 189 - protein, 698 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 190 - protein, 698 aa, Homo sapiens; identical to SEQ ID NO: 189

SEQ ID NO: 191 - protein, 698 aa, Homo sapiens; identical to SEQ ID NO: 189

SEQ ID NO: 192 - protein, 698 aa, Homo sapiens; identical to SEQ ID NO: 189

SEQ ID NO: 193 - protein, 722 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 194 - protein, 620 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVSGAAAYRPCPPLDPGKGPPCLPLVIGAIVGLPRCTETVAVSLRIFPLVLAMPLQGNALQLVRESPSFWFSYSL

SEQ ID NO: 195 - protein, 722 aa, Homo sapiens; identical to SEQ ID NO: 193

SEQ ID NO: 196 - protein, 549 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKMCP

SEQ ID NO: 197 - protein, 722 aa, Homo sapiens; identical to SEQ ID NO: 193

SEQ ID NO: 198 - protein, 620 aa, Homo sapiens; identical to SEQ ID NO: 194

SEQ ID NO: 199 - protein, 1881 aa, Homo sapiens
MSCPDELVVPAVAIGLVCPERLAVPTPPTGGPQEARRHRVRGAMALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 200 - protein, 1838 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQQEGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 201 - protein, 1126 aa, Homo sapiens [sequence omitted]

SEQ ID NO: 202 - protein, 365 aa, Homo sapiens
MAVMAPRTLLLLLSGALALTQTWAGSHSMRYFYTSVSRPGRGEPRFIAVGYVDDTQFVRFDSDAASQRMEPRAPWIEQEGPEYWDQETRNVKAQSQTDRVDLGTLRGYYNQSEDGSHTIQIMYGCDVGPDGRFLRGYRQDAYDGKDYIALNEDLRSWTAADMAAQITKRKWEAAHAAEQQRAYLEGRCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 203 - protein, 365 aa, Homo sapiens
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 204 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 205 - protein, 365 aa, Homo sapiens
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 206 - protein, 370 aa, Homo sapiens
MARGDQAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 207 - protein, 365 aa, Homo sapiens
MAVMAPRTLLLLLSGALALTHTWAGSHSMRYFSTSVSRPGSGEPRFIAVGYVDDTQFVRFDSDAASQRMEPRAPWIEQERPEYWDQETRNVKAQSQTDRVDLGTLRGYYNQSEAGSHTIQIMYGCDVGSDGRFLRGYEQHAYDGKDYIALNEDLRSWTAADMAAQITQRKWEAARWAEQLRAYLEGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 208 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 209 - protein, 264 aa, Homo sapiens
CDPPAKGCQGLFHYGLCVLPFRHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 210 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKQNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 211 - protein, 793 aa, Homo sapiens
PLYACLLGLCALLPRFAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 212 - protein, 799 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 213 - protein, 820 aa, Homo sapiens
AAERSQPLPYPEQPAGAVQSGDTLGVPAGQPGQPRSRDSAVSAAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 214 - protein, 259 aa, Homo sapiens
MEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLEVRVGMLF

SEQ ID NO: 215 - protein, 2602 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVNCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNMVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 216 - protein, 2468 aa, Homo sapiens [sequence omitted]

SEQ ID NO: 217 - protein, 2598 aa, Homo sapiens [sequence omitted]

SEQ ID NO: 218 - protein, 2147 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRADDTDSQSWRSPLKALSEFFKGDPKGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPGVRVMNCSAQILWGWRVQFHTGSR

SEQ ID NO: 219 - protein, 2622 aa, Homo sapiens [sequence omitted]

SEQ ID NO: 220 - protein, 2622 aa, Homo sapiens [sequence omitted]

SEQ ID NO: 221 - protein, 2534 aa, Homo sapiens [sequence omitted]

SEQ ID NO: 222 - protein, 530 aa, Homo sapiens
MACTGWTSPLPLCVCLLLTCGFAEAGKLLVVPMDGSHWFTMRSVVEKLILRGHEVVVVMPEVSWQLGRSLNCTVKTYSTSYTLEDLDREFKAFAHAQWKAQVRSIYSLLMGSYNDIFDLFFSNCRSLFKDKKLVEYLKESSFDAVFLDPFDNCGLIVAKYFSLPSVVFARGILCHYLEEGAQCPAPLSYVPRILLGFSDAMTFKERVRNHIMHLEEHLLCHRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 223 - protein, 530 aa, Homo sapiens; identical to SEQ ID NO: 222

SEQ ID NO: 224 - protein, 530 aa, Homo sapiens
MACTGWTSPLPLCVCLLLTCGFAEAGKLVVVPMDGSHWFTMRSVVEKLILRGHEVVVVSARGELATGKINELHSEDLFNFIYLEDLDREFKAFAHAQWKAQVRSIYSLLMGSYNDIFDLFFSNCRSLFKDKKLVEYLKESSFDAVFLDPFDNCGLIVAKYFSLPSVVFARGILCHYLEEGAQCPAPLSYVPRILLGFSDDMTFKERVRNHIMHLEEHLLCHRFFKNALEIASEILQTPVTEYDLYSHTSIWLLRTDFVLDYPKPVMPNMIFIGGINCHERKALPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 225 - protein, 544 aa, Homo sapiens [sequence omitted]

SEQ ID NO: 226 - protein, 544 aa, Homo sapiens
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 227 - protein, 2048 aa, Homo sapiens
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 228 - protein, 1574 aa, Homo sapiens [sequence omitted]

SEQ ID NO: 229 - protein, 1769 aa, Homo sapiens
MILPNSPPNRTDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKCLSSMSTALSKMASPATVHLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNIILPACDHLEHQGRYLGREKHHRRGNE

SEQ ID NO: 230 - protein, 2044 aa, Homo sapiens
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 231 - protein, 2057 aa, Homo sapiens
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 232 - protein, 2061 aa, Homo sapiens
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 233 - protein, 242 aa, Homo sapiens
MADPWQECMDYAVTLARQAGEVVCEAIKNEMNVMLKSSPVDLVTATDQKVEKMLISSIKEKYPSHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 234 - protein, 277 aa, Homo sapiens
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 235 - protein, 104 aa, Homo sapiens
MVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 236 - protein, 277 aa, Homo sapiens; identical to SEQ ID NO: 234

SEQ ID NO: 237 - protein, 148 aa, Homo sapiens
MYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 238 - protein, 277 aa, Homo sapiens; identical to SEQ ID NO: 234

SEQ ID NO: 239 - protein, 203 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 240 - protein, 160 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIAVRPKTWLCNRQAQTRLMLSVVPRIG

SEQ ID NO: 241 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 242 - protein, 151 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIDICQPHFPKDRGLNLLM

SEQ ID NO: 243 - protein, 138 aa, Homo sapiens
GSQQRPRSGAQWSCRLVSPRHGQKLVSDCTEFTETECLPCGESEFLDTWNRETHCHQHKYCDPNLGLRVQQKGTSETDTICTCEEGWHCTSEACESCVLHRSCSPGFGVKQIAVRPKTWLCNRQAQTRLMLSVVPRIG

SEQ ID NO: 244 - protein, 191 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGLGLE

SEQ ID NO: 245 - protein, 277 aa, Homo sapiens; identical to SEQ ID NO: 241

SEQ ID NO: 246 - protein, 277 aa, Homo sapiens; identical to SEQ ID NO: 241

SEQ ID NO: 247 - protein, 608 aa, Homo sapiens
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 248 - protein, 608 aa, Homo sapiens; identical to SEQ ID NO: 247

SEQ ID NO: 249 - protein, 608 aa, Homo sapiens; identical to SEQ ID NO: 247

SEQ ID NO: 250 - protein, 858 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 251 - protein, 858 aa, Homo sapiens; identical to SEQ ID NO: 250

SEQ ID NO: 252 - protein, 857 aa, Homo sapiens
VNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 253 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALSLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 254 - protein, 1741 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEAQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALSLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 255 - protein, 1744 aa, Homo sapiens [sequence omitted]

SEQ ID NO: 256 - protein, 120 aa, Homo sapiens
EVQLVESGGGLVQPGRSLRLSCAASGFTFDDYSMHWVRQAPGKGLEWVSGLNWNSGSIGYADSVKGRFTISRDNAKNSLYLQMNSLRAEDTALYYCAKYSYSSSNWFDPWGQGTLVTVSS

SEQ ID NO: 257 - protein, 282 aa, Homo sapiens
MSGGWMAQVGAWRTGALGLALLLLLGLGLGLEAAASPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 258 - protein, 282 aa, Homo sapiens; identical to SEQ ID NO: 257

SEQ ID NO: 259 - protein, 264 aa, Homo sapiens
MSGGWMAQVGAWRTGALGLALLLLLGLGLGLEAAASPLSTPTSAQAAGPSSGSCPPTKDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 260 - protein, 158 aa, Homo sapiens
GGVHRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 261 - protein, 193 aa, Homo sapiens [sequence omitted]

SEQ ID NO: 262 - protein, 48 aa, Homo sapiens
MVSRSEVDMLKIRSEFKRKYGKSLYYYIQQDTKGDYQKALLYLCGGDD

SEQ ID NO: 263 - protein, 29 aa, Homo sapiens
MACPRTITSSKTLRTTTQKALLYLCGGDD

SEQ ID NO: 264 - protein, 751 aa, Homo sapiens [sequence omitted]

SEQ ID NO: 265 - protein, 314 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 266 - protein, 335 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 267 - protein, 335 aa, Homo sapiens; identical to SEQ ID NO: 266

SEQ ID NO: 268 - protein, 96 aa, Homo sapiens
MTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 269 - protein, 127 aa, Homo sapiens [sequence omitted]

SEQ ID NO: 270 - protein, 313 aa, Homo sapiens [sequence omitted]

SEQ ID NO: 271 - protein, 96 aa, Homo sapiens; identical to SEQ ID NO: 268

SEQ ID NO: 272 - protein, 96 aa, Homo sapiens; identical to SEQ ID NO: 268

SEQ ID NO: 273 - protein, 96 aa, Homo sapiens; identical to SEQ ID NO: 268

SEQ ID NO: 274 - protein, 334 aa, Homo sapiens [sequence omitted]

SEQ ID NO: 275 - protein, 2261 aa, Homo sapiens [sequence omitted]

SEQ ID NO: 276 - protein, 2261 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDATKQMKKHLKLAKDSSADRFLNSLGRFMTGLDTRNNVKVWFNNKGWHAISSFLNVINNAILRANLQKGENPSHYGITAFNHPLNLTKQQLSEVAPMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVPKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 277 - protein, 172 aa, Homo sapiens
MMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 278 - protein, 356 aa, Homo sapiens [sequence omitted]

SEQ ID NO: 279 - protein, 303 aa, Homo sapiens
MAAVAVLRAFGASGPMCLRRGPWAQLPARFCSRDPAGAGRRESEPRPTSARQLDGIRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 280 - protein, 303 aa, Homo sapiens; identical to SEQ ID NO: 279

SEQ ID NO: 281 - protein, 548 aa, Homo sapiens
MTMAAAAVVARGAGARAATAAALRGGCGTAARGRPCAGPARPLCTAPGTAPDMKRYLWERYREAKRSTEELVPSIMSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 282 - protein, 543 aa, Homo sapiens [sequence omitted]

SEQ ID NO: 283 - protein, 473 aa, Homo sapiens
MSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 284 - protein, 548 aa, Homo sapiens [sequence omitted]

SEQ ID NO: 285 - protein, 560 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLAEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAGRERNALW

SEQ ID NO: 286 - protein, 423 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLRNALW

SEQ ID NO: 287 - protein, 435 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLVPPPAHALTGPAQSSTH

SEQ ID NO: 288 - protein, 829 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGESRAQTLGAGVPPGDSVRGSMEASQVQVPLEASPITFPPPCAPERPPISPVPGARQAGL

SEQ ID NO: 289 - protein, 418 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDL

SEQ ID NO: 290 - protein, 882 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 291 - protein, 611 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLAEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 292 - protein, 781 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 293 - protein, 633 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 294 - protein, 585 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 295 - protein, 611 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQARTPASPHFRSQGAQPQQVTLRLALRLGNFPVRH

SEQ ID NO: 296 - protein, 824 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLAEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 297 - protein, 555 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAGRE

SEQ ID NO: 298 - protein, 508 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAGREV

SEQ ID NO: 299 - protein, 2278 aa, Homo sapiens
MLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 300 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 301 - protein, 2278 aa, Homo sapiens; identical to SEQ ID NO: 299

SEQ ID NO: 302 - protein, 2150 aa, Homo sapiens [sequence omitted]

SEQ ID NO: 303 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKHLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 304 - protein, 313 aa, Homo sapiens
MASQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRVSYRSQTYQNYKNFNSRRTASDQPWSGL

SEQ ID NO: 305 - protein, 2364 aa, Homo sapiens; identical to SEQ ID NO: 300

SEQ ID NO: 306 - protein, 2364 aa, Homo sapiens; identical to SEQ ID NO: 300

SEQ ID NO: 307 - protein, 2155 aa, Homo sapiens
MELQRTSSISGPLSPAYTGQVPYNYNQLEGRFKQLQDEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRVSYRSQTYQNYKNFNSRRTASDQPWSGL

SEQ ID NO: 308 - protein, 2105 aa, Homo sapiens
MMPSACGRPSLSWSVRRRSSNRRPNCCSSSLRRMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 309 - protein, 2105 aa, Homo sapiens; identical to SEQ ID NO: 308

SEQ ID NO: 310 - protein, 2105 aa, Homo sapiens; identical to SEQ ID NO: 308

SEQ ID NO: 311 - protein, 4684 aa, Homo sapiens [sequence omitted]

SEQ ID NO: 312 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 313 - protein, 346 aa, Homo sapiens; identical to SEQ ID NO: 312

SEQ ID NO: 314 - protein, 359 aa, Homo sapiens [sequence omitted]

SEQ ID NO: 315 - protein, 346 aa, Homo sapiens; identical to SEQ ID NO: 312

SEQ ID NO: 316 - protein, 346 aa, Homo sapiens; identical to SEQ ID NO: 312

SEQ ID NO: 317 - protein, 357 aa, Homo sapiens
MNLILRYTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 318 - protein, 345 aa, Homo sapiens
AMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 319 - protein, 361 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 320 - protein, 287 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENLRKLKPREVL

SEQ ID NO: 321 - protein, 361 aa, Homo sapiens; identical to SEQ ID NO: 319

SEQ ID NO: 322 - protein, 777 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRCGWLGVAAGTGLREASRTPQASRCQRPVLPCRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 323 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 324 - protein, 677 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDR

SEQ ID NO: 325 - protein, 745 aa, Homo sapiens; identical to SEQ ID NO: 323

SEQ ID NO: 326 - protein, 792 aa, Homo sapiens
MGVPFFSSLRCMVDLGPCWAGGLTAEMKLLLALAGLLAILATPQPSEGAAPAVLGEVDTSLVLSSMEEAKQLVDKAYKERRERWGTRHCPALGKDVPGLSEKQQAAGSLKVGEGDYGDPCGLPFCLSVPVIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 327 - protein, 618 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYCMPPRLCPQLGLRARG

SEQ ID NO: 328 - protein, 669 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 329 - protein, 1020 aa, Homo sapiens
MQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 330 - protein, 1020 aa, Homo sapiens [sequence omitted]

SEQ ID NO: 331 - protein, 862 aa, Homo sapiens [sequence omitted]

SEQ ID NO: 332 - protein, 147 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 333 - protein, 146 aa, Homo sapiens
VHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 334 - protein, 224 aa, Homo sapiens
MAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 335 - protein, 354 aa, Homo sapiens
MVPCAVLEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 336 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 337 - protein, 1257 aa, Homo sapiens; identical to SEQ ID NO: 336

SEQ ID NO: 338 - protein, 1248 aa, Homo sapiens
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 339 - protein, 1255 aa, Homo sapiens [sequence omitted]

SEQ ID NO: 340 - protein, 1253 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 341 - protein, 488 aa, Homo sapiens
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 342 - protein, 498 aa, Homo sapiens
MSHQPAVATKMPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 343 - protein, 488 aa, Homo sapiens; identical to SEQ ID NO: 341

SEQ ID NO: 344 - protein, 346 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 345 - protein, 333 aa, Homo sapiens
MVSGSSGLAAARLLSRSFLLPQNGIRHCSYTASRQHLYVDKNTKIICQGFTGKQGTFHSQQALEYGTKLVGGTLPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 346 - protein, 333 aa, Homo sapiens [sequence omitted]

SEQ ID NO: 347 - protein, 747 aa, Homo sapiens
MEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 348 - protein, 629 aa, Homo sapiens
MEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 349 - protein, 904 aa, Homo sapiens [sequence omitted]

SEQ ID NO: 350 - protein, 746 aa, Homo sapiens
MEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDGPSIFHIQENVMRHRYQRLDRHFTF

SEQ ID NO: 351 - protein, 148 aa, Homo sapiens [sequence omitted]

SEQ ID NO: 352 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 353 - protein, 416 aa, Homo sapiens
SLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 354 - protein, 148 aa, Homo sapiens [sequence omitted]

SEQ ID NO: 355 - protein, 152 aa, Homo sapiens
MRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGGVTKGR

SEQ ID NO: 356 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 357 - protein, 893 aa, Homo sapiens; identical to SEQ ID NO: 356

SEQ ID NO: 358 - protein, 893 aa, Homo sapiens; identical to SEQ ID NO: 356

SEQ ID NO: 359 - protein, 893 aa, Homo sapiens; identical to SEQ ID NO: 356

SEQ ID NO: 360 - protein, 893 aa, Homo sapiens; identical to SEQ ID NO: 356

SEQ ID NO: 361 - protein, 666 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 362 - protein, 607 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 363 - protein, 607 aa, Homo sapiens; identical to SEQ ID NO: 362

SEQ ID NO: 364 - protein, 607 aa, Homo sapiens; identical to SEQ ID NO: 362

SEQ ID NO: 365 - protein, 607 aa, Homo sapiens; identical to SEQ ID NO: 362

SEQ ID NO: 366 - protein, 803 aa, Homo sapiens
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 367 - protein, 803 aa, Homo sapiens; identical to SEQ ID NO: 366

SEQ ID NO: 368 - protein, 570 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 369 - protein, 570 aa, Homo sapiens; identical to SEQ ID NO: 368

SEQ ID NO: 370 - protein, 433 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPR

SEQ ID NO: 371 - protein, 1010 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPRSLTYKESGVDIAAGNMLVKKIQPLAKATSRSGCKVDLGGFAGLFDLKAAGFKDPLLASGTDGVGTKLKIAQLCNKHDTIGQDLVAMCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 372 - protein, 1010 aa, Homo sapiens; identical to SEQ ID NO: 371

SEQ ID NO: 373 - protein, 514 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPRSLTYKESGVDIAAGNMLVKKIQPLAKATSRSGCKVDLGGFAGLFDLKAAGFKDPLLASGTDGVGTKLKVLRAANQMDKIQF

SEQ ID NO: 374 - protein, 1010 aa, Homo sapiens; identical to SEQ ID NO: 371

SEQ ID NO: 375 - protein, 433 aa, Homo sapiens; identical to SEQ ID NO: 370

SEQ ID NO: 376 - protein, 224 aa, Homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 377 - protein, 224 aa, Homo sapiens; identical to SEQ ID NO: 376

SEQ ID NO: 378 - protein, 223 aa, Homo sapiens
PGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 379 - protein, 167 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDV

SEQ ID NO: 380 - protein, 534 aa, Homo sapiens [sequence omitted]

SEQ ID NO: 381 - protein, 239 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 382 - protein, 133 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMADSPQEWPFLPRGVQPSKRAHER

SEQ ID NO: 383 - protein, 238 aa, Homo sapiens
APSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 384 - protein, 232 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 385 - protein, 843 aa, Homo sapiens
MAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 386 - protein, 862 aa, Homo sapiens
MAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGSWPALQLQHLPHPEWESGGATCWAPPELCTHLAMY

SEQ ID NO: 387 - protein, 843 aa, Homo sapiens; identical to SEQ ID NO: 385

SEQ ID NO: 388 - protein, 842 aa, Homo sapiens
AKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 389 - protein, 843 aa, Homo sapiens; identical to SEQ ID NO: 385

SEQ ID NO: 390 - protein, 494 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 391 - protein, 494 aa, Homo sapiens [sequence omitted]

SEQ ID NO: 392 - protein, 427 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 393 - protein, 494 aa, Homo sapiens; identical to SEQ ID NO: 390

SEQ ID NO: 394 - protein, 1273 aa, Homo sapiens
MPCFYLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKFELHLMDRDLLQIIFSFSKAGYLSMSQKFWKKFTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINVWSEITELLYKDGRYCQEPRGPTEAVGNFLYNLIDSMSDSEVQAKEEHLRQYFHQLEKMNVKIPENIYRGIRNLLESYHVPELIKDAHLLVERKNLDFQKTVQLTSSELESTLETLKAENQPIRDVLKQLILVLCSEENMQKALELKAKYESDMVTGGYAALINLCCRHDKVEDALNLKEEFDRLDSSAVLDTGNYLGLVRVLAKHGKLQDAIKILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 395 - protein, 1394 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 396 - protein, 602 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 397 - protein, 576 aa, Homo sapiens
LGLFQGCVSSRCTVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 398 - protein, 609 aa, Homo sapiens [sequence omitted]

SEQ ID NO: 399 - protein, 404 aa, Homo sapiens
LDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 400 - protein, 544 aa, Homo sapiens
LPLLITEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 401 - protein, 609 aa, Homo sapiens [sequence omitted]

SEQ ID NO: 402 - protein, 478 aa, Homo sapiens
LLPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 403 - protein, 404 aa, Homo sapiens; identical to SEQ ID NO: 399

SEQ ID NO: 404 - protein, 510 aa, Homo sapiens [sequence omitted]

SEQ ID NO: 405 - protein, 426 aa, Homo sapiens
NCQKTSLLLCPGTPFLCCLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 406 - protein, 405 aa, Homo sapiens
KLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 407 - protein, 417 aa, Homo sapiens
MKWVTFISLLFLFSSAYSRGVFRRDAHKSEVAHRFKDLGEENFKALAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 408 - protein, 328 aa, Homo sapiens
ADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 409 - protein, 518 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYWKSMKHTFPKSLMLKHSPSMQIYAHFLRRRDKSRNKLHLLSS

SEQ ID NO: 410 - protein, 110 aa, Homo sapiens
MFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 411 - protein, 142 aa, Homo sapiens
MVLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 412 - protein, 141 aa, Homo sapiens
VLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 413 - protein, 950 aa, Homo sapiens
MAASTGYVRLWGAARCWVLRRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 414 - protein, 959 aa, Homo sapiens
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 415 - protein, 959 aa, Homo sapiens; identical to SEQ ID NO: 414

SEQ ID NO: 416 - protein, 959 aa, Homo sapiens; identical to SEQ ID NO: 414

SEQ ID NO: 417 - protein, 261 aa, Homo sapiens
MSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFTVQQRGAAVIKARKLSSAMSAAKAICDHVRDIWFGTPE

SEQ ID NO: 418 - protein, 334 aa, Homo sapiens
MSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 419 - protein, 333 aa, Homo sapiens
SEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 420 - protein, 289 aa, Homo sapiens
MMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 421 - protein, 527 aa, Homo sapiens [sequence omitted]

SEQ ID NO: 422 - protein, 202 aa, Homo sapiens [sequence omitted]

SEQ ID NO: 423 - protein, 552 aa, Homo sapiens
MTQPFNYSAFERIIFAGTSAAMSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 424 - protein, 530 aa, Homo sapiens
SKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 425 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 426 - protein, 649 aa, Homo sapiens [sequence omitted]

SEQ ID NO: 427 - protein, 1066 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 428 - protein, 993 aa, Homo sapiens
MPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 429 - protein, 1134 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 430 - protein, 1133 aa, Homo sapiens
PVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 431 - protein, 1134 aa, Homo sapiens; identical to SEQ ID NO: 429

SEQ ID NO: 432 - protein, 1066 aa, Homo sapiens; identical to SEQ ID NO: 427

SEQ ID NO: 433 - protein, 162 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQIKQETGSLAKICCHVRR

SEQ ID NO: 434 - protein, 427 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 435 - protein, 427 aa, Homo sapiens; identical to SEQ ID NO: 434

SEQ ID NO: 436 - protein, 657 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 437 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 438 - protein, 1210 aa, Homo sapiens [sequence omitted]

SEQ ID NO: 439 - protein, 1210 aa, Homo sapiens [sequence omitted]

SEQ ID NO: 440 - protein, 740 aa, Homo sapiens [sequence omitted]

SEQ ID NO: 441 - protein, 350 aa, Homo sapiens [sequence omitted]

SEQ ID NO: 442 - protein, 770 aa, Homo sapiens [sequence omitted]

SEQ ID NO: 443 - protein, 573 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 444 - protein, 573 aa, Homo sapiens; identical to SEQ ID NO: 443

SEQ ID NO: 445 - protein, 695 aa, Homo sapiens [sequence omitted]

SEQ ID NO: 446 - protein, 573 aa, Homo sapiens; identical to SEQ ID NO: 443

SEQ ID NO: 447 - protein, 573 aa, Homo sapiens; identical to SEQ ID NO: 443

SEQ ID NO: 448 - protein, 573 aa, Homo sapiens; identical to SEQ ID NO: 443

SEQ ID NO: 449 - protein, 384 aa, Homo sapiens
MKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 450 - protein, 575 aa, Homo sapiens [sequence omitted]

SEQ ID NO: 451 - protein, 129 aa, Homo sapiens
MEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 452 - protein, 206 aa, Homo sapiens
MEPGEPLQRLVRRRPEPGGPRGGEARRADAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIGQECFLVCVLESLPALFHGSEMPLGPVQVYLSLISESCSSCLTLPHGSSVHLSITVLNPFSISV

SEQ ID NO: 453 - protein, 132 aa, Homo sapiens
ARRATRRRSAAGRRYEDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 454 - protein, 254 aa, Homo sapiens
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 455 - protein, 201 aa, Homo sapiens
MAAYKLVLIRHGESAWNLENRFSGWYDADLSPAGHEEAKRGGQALRDAGYEFDICFTSVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 456 - protein, 254 aa, Homo sapiens; identical to SEQ ID NO: 454

SEQ ID NO: 457 - protein, 254 aa, Homo sapiens; identical to SEQ ID NO: 454

SEQ ID NO: 458 - protein, 201 aa, Homo sapiens; identical to SEQ ID NO: 455

SEQ ID NO: 459 - protein, 99 aa, Homo sapiens
MEPDHPFYSNISKDRRYADLTEDQLPSCESLKDTIGQECFLVCVLESLPALFHGSEMPLGPVQVYLSLISESCSSCLTLPHGSSVHLSITVLNPFSISV

SEQ ID NO: 460 - protein, 236 aa, Homo sapiens
MEPGEPLQRLVRRRPEPGGPRGGEARRADAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 461 - protein, 253 aa, Homo sapiens
AAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 462 - protein, 254 aa, Homo sapiens; identical to SEQ ID NO: 454

SEQ ID NO: 463 - protein, 170 aa, Homo sapiens
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPSGMKK

SEQ ID NO: 464 - protein, 117 aa, Homo sapiens [sequence omitted]

SEQ ID NO: 465 - protein, 254 aa, Homo sapiens; identical to SEQ ID NO: 454

SEQ ID NO: 466 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 467 - protein, 1752 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 468 - protein, 734 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGIHPGLCEDLRSCVQCQAWGTGEKKGRTCEECNFKVKMVDELKRAEEVVVRCSFRDEDDDCTYSYTMEGDGAPGPNSTVLVHKKKGTTSPCLLLSRLPSGLLLVAHPPAPPPPAAPGPATAAMLEVLCLLQGLPGTSPVLQPRSHGGL

SEQ ID NO: 469 - protein, 964 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAGDVAERGLQADLRCTQAPADQVPAAAQCREKARPHHCGHSADGAPLGQAGPAEAYREAGGTEGLPRPQGGPRLLHPHCRPGRPGHGGVPGGRGAGGRTGAPLYPA

SEQ ID NO: 470 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 471 - protein, 1875 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 472 - protein, 1822 aa, Homo sapiens; identical to SEQ ID NO: 470

SEQ ID NO: 473 - protein, 1822 aa, Homo sapiens [sequence omitted]

SEQ ID NO: 474 - protein, 1805 aa, Homo sapiens; identical to SEQ ID NO: 466

SEQ ID NO: 475 - protein, 1752 aa, Homo sapiens; identical to SEQ ID NO: 467

SEQ ID NO: 476 - protein, 1875 aa, Homo sapiens; identical to SEQ ID NO: 471

SEQ ID NO: 477 - protein, 1822 aa, Homo sapiens; identical to SEQ ID NO: 470

SEQ ID NO: 478 - protein, 1702 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 479 - protein, 1752 aa, Homo sapiens; identical to SEQ ID NO: 467

SEQ ID NO: 480 - protein, 917 aa, Homo sapiens
MIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVNEYSLNAGKQRYEKMISGMYLGEIVRNILIDFTKKGFLFRGQISETMKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 481 - protein, 905 aa, Homo sapiens
MAKRALRDFIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 482 - protein, 916 aa, Homo sapiens
MDCEHSLSLPCRGAEAWEIGIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 483 - protein, 916 aa, Homo sapiens; identical to SEQ ID NO: 482

SEQ ID NO: 484 - protein, 921 aa, Homo sapiens
MGQICQRESATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 485 - protein, 905 aa, Homo sapiens; identical to SEQ ID NO: 481

SEQ ID NO: 486 - protein, 921 aa, Homo sapiens; identical to SEQ ID NO: 484

SEQ ID NO: 487 - protein, 969 aa, Homo sapiens
MGQICQRESATAAEKPKLHLLAESEPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 488 - protein, 921 aa, Homo sapiens; identical to SEQ ID NO: 484

SEQ ID NO: 489 - protein, 764 aa, Homo sapiens
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 490 - protein, 764 aa, Homo sapiens [sequence omitted]

SEQ ID NO: 491 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 492 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAKWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 493 - protein, 569 aa, Homo sapiens [sequence omitted]

SEQ ID NO: 494 - protein, 152 aa, Homo sapiens
LPSASKEPDNHVYTRAAVAADAKQCSEIGRGLSVAVPGEIRGYELAHQQHGRLPWARLFQPSIQLARQGFPVGKGLAAALENKRTVIEQQPVLCEVFCRDRKVLWEGERLILLRLADTYETLAIEGAQAFYNGSLMAQIVKDIQAAGEWVTS

SEQ ID NO: 495 - protein, 148 aa, Homo sapiens
LPSASKEPDNHVYTRAAVAADAKQCSEIGRGLSVAVPGEIRGYELAHQQHGRLPWARLFQPSIQLARQGFPVGKGLAAALENKRTVIEQQPVLCEVFCRDRKVLWEGERLILLRLADTYETLAIEGAQAFYNGSLMAQIVKDIQAAGE

SEQ ID NO: 496 - protein, 569 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDAVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 497 - protein, 569 aa, Homo sapiens [sequence omitted]

SEQ ID NO: 498 - protein, 569 aa, Homo sapiens [sequence omitted]

SEQ ID NO: 499 - protein, 824 aa, Homo sapiens [sequence omitted]

SEQ ID NO: 500 - protein, 1287 aa, Homo sapiens
  VARIANT (1)...(1287): Xaa = Any Amino Acid
MKKKLVVLGLLAVVLVLVIVGLCLXLPSASKEPDNHVYTRAAVAADAKQCSEIGRVTNCGSLSPGGLSVAVPGEIRGYELAHQQHGRLPWARLFQPSIQLARQGFPVGKGLAAALENKRTVIEQQPVLCEVFCRDRKVLWEGERLILLRLADTYETLAIEGAQAFYNGSLMAQIVKDIQAADNIWVLGCNESSLLTSFFVFGCTFPITSHSSKANLCRPSTPSPLFCPASPRLFAPPPPPLRLFAPRRGGFLTLIAAAFCPPPPRLFDPHRRSFLLSAAAAFLPPPPPRLFARLGFLHLRRRGFFPTAVFCPPRRLGFMPTTAFSSLPPRLFARPGFLPPRHRSFLPAAAFCTPTTAAFCRPPPRLIAPHRRGFLTPAAAAFCLPRLFAPAAFCSPPPRLFAPPPPRLFAARRRVFLPAPAFCPHAVAAFWRPRCRGYLPAAAFCTPGAAAFCPPPPRLFAGRGFLPDPAFCPPRLFHPRRRGFLPPRLFAGPGFLPPHRRGFLPPAAAAFCPPAAAAFCPPRFFTPAAATFCRRGFLPPTTAAAFSPPPPRLFVAAAFLPPPPPHRARCRDYLPAAAFCSPPPRLFVPPLPPSRFFAHLGFLPPAASAFCPPAAAGFCRPRLFAPPRLFAPALPRLFARSGFLRSPPPPPPPTVPRLFTGGGSLHPRRRGFLSPAAVAFCPMAILRSAAHTRCRSQPQSGHSTDVRAPTQLLGLLGLWLPGARCDIQMTQSPSSLSASVGGRVTITCRASQGISNNLNWYQQKPGKTPKLLIYAASSLQSGIPSRFSDSGSGADYTLTISSLQPEDFAAYYCQQSDTDTRIRERTLMVTFLSGAYFGDPGENLSPSLSTAAQHGPQCRGYLPTRAFCTPAARLFDASRHGFLPPAAAAFCPPRLFAPPPRLFAPCRRGFLPAMAFCPPRHCGFLPLCRRGFLSQRLFARSGFLPPLPRCLGFLHTRRRGFLSAAAFCPPRLFDSPLLRLFPRRGFLPPAPTAFYRPRLFAPTLPRVIYPDSVEGMRRKGYPEQDLEAILDIVHLHHILQWEGDRQGRRGTGALSSQLAHSRSSPSSPAGPQVWVLVELSQDHCPCLGWEAMCDWKDVLPGGEKQRIGMARMFYHRPKYALLDECTSAVSIDVEGKIFQAAKDAGIALLSITHQPSCGRCPVSLPGVSGSGCLRGGGGLLGQAAAAGGCHQQPSCHAPDPVPLLAREYHTHLLQFDGEGGWKFEKLGSAARLSLTEEKQRLEQQLAGIPKMQRHLQELCQILGEAVAPAHVPAPSPQGPGGLQGAST

SEQ ID NO: 501 - protein, 148 aa, Homo sapiens; identical to SEQ ID NO: 495

SEQ ID NO: 502 - protein, 134 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIR

SEQ ID NO: 503 - protein, 169 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIHLLLMVMIMALFGPLGKPGGIP

SEQ ID NO: 504 - protein, 243 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKDLDICLLLAQQNFGWEMRRFI

SEQ ID NO: 505 - protein, 453 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRIMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 506 - protein, 419 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 507 - protein, 453 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 508 - protein, 453 aa, Homo sapiens; identical to SEQ ID NO: 507

SEQ ID NO: 509 - protein, 238 aa, Homo sapiens [sequence omitted]

SEQ ID NO: 510 - protein, 437 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 511 - protein, 437 aa, Homo sapiens; identical to SEQ ID NO: 510

SEQ ID NO: 512 - protein, 243 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 513 - protein, 420 aa, Homo sapiens [sequence omitted]

SEQ ID NO: 514 - protein, 404 aa, Homo sapiens
GKRNGKDLPTLLYVATRDNCCILDERFGSYCPTTCGIADFLSTYQTKVDKDLQSLEDILHQVENKTSEVKQLIKAIQLTYNPDESSKPNMIDAATLKSRKIYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 515 - protein, 204 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSWRRLKDRFKRDLLF

SEQ ID NO: 516 - protein, 422 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 517 - protein, 154 aa, Homo sapiens [sequence omitted]

SEQ ID NO: 518 - protein, 4655 aa, Homo sapiens
MDRGPAAVACTLLLALVACLAPASGQECDSAHFRCGSGHCIPADWRCDGTKDCSDDADEIGCAVVTCQQGYFKCQSEGQCIPSSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 519 - protein, 4655 aa, Homo sapiens [sequence omitted]

SEQ ID NO: 520 - protein, 2483 aa, Homo sapiens [sequence omitted]

SEQ ID NO: 521 - protein, 2524 aa, Homo sapiens [sequence omitted]

SEQ ID NO: 522 - protein, 780 aa, Homo sapiens
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 523 - protein, 830 aa, Homo sapiens
MRSMCNQGRGRESSRGGLHVQGSCRGLSRSPQQETGFAKAPAGTDCFFHCSPGSRGQGDRKEEVTSEPGGTSIMSRLGGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 524 - protein, 780 aa, Homo sapiens; identical to SEQ ID NO: 522

SEQ ID NO: 525 - protein, 779 aa, Homo sapiens
AAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTAWTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 526 - protein, 555 aa, Homo sapiens
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 527 - protein, 555 aa, Homo sapiens; identical to SEQ ID NO: 526

SEQ ID NO: 528 - protein, 312 aa, Homo sapiens
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 529 - protein, 1783 aa, Homo sapiens [sequence omitted]

SEQ ID NO: 530 - protein, 1685 aa, Homo sapiens [sequence omitted]

SEQ ID NO: 531 - protein, 1781 aa, Homo sapiens [sequence omitted]

SEQ ID NO: 532 - protein, 379 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPICNFPPKIAHGHYKQSSSYSFFKEEIIYECDKGYILVGQAKLSCSYSHWSAPAPQCKEKRCRNPELINGIVEVKKDLLLGSTI

SEQ ID NO: 533 - protein, 597 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 534 - protein, 597 aa, Homo sapiens; identical to SEQ ID NO: 533

SEQ ID NO: 535 - protein, 597 aa, Homo sapiens; identical to SEQ ID NO: 533

SEQ ID NO: 536 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 537 - protein, 245 aa, Homo sapiens
GDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 538 - protein, 246 aa, Homo sapiens; identical to SEQ ID NO: 536

SEQ ID NO: 539 - protein, 233 aa, Homo sapiens
MIDVPHSTSVTWRTVLVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 540 - protein, 492 aa, Homo sapiens
TANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 541 - protein, 493 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKDSTGKYWTVGSDSAVTSSGDTPVDFFFEFCDYNKVAIKVGGRYLKGDHAGVLKASAETVDPASLWEY

SEQ ID NO: 542 - protein, 437 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETADSTGKYWTVGSDSAVTSSGDTPVDFFFEFCDYNKVAIKVGGRYLKGDHAGVLKASAETVDPASLWEY

SEQ ID NO: 543 - protein, 438 aa, Homo sapiens
MTANGTAEAVQIQFGLINCGNKYLTAEAFGFKVNASASSLKKKQIWTLEQPPDEAGSAAVCLRSHLGRYLAADKDGNVTCEREVPGPDCRFLIVAHDDGRWSLQSEAHRRYFGGTEDRLSCFAQTVSPAEKWSVHIAMHPQVNIYSVTRKRYAHLSARPADEIAVDRDVPWGVDSLITLAFQDQRYSVQTADHRFLRHDGRLVARPEPATGYTLEFRSGKVAFRDCEGRYLAPSGPSGTLKAGKATKVGKDELFALEQSCAQVVLQAANERNVSTRQGMDLSANQDEETDQETFQLEIDRDTKKCAFRTHTGKYWTLTATGGVQSTASSKNASCYFDIEWRDRRITLRASNGKFVTSKKNGQLAASVETAGDSELFLMKLINRPIIVFRGEHGFIGCRKVTGTLDANRSSYDVFQLEFNDGAYNIKGRLHRQILDGGQ

SEQ ID NO: 544 - protein, 908 aa, Homo sapiens [sequence omitted]

SEQ ID NO: 545 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 546 - protein, 96 aa, Homo sapiens
MKERSWPAVGNCSSALRWLGRYYCFQGNQFLRFDPVRGEVPPRYPRDVRDYFMPCPGRGEKALALETCQNSSTFPELVDLTCPSSHFNSVLRHLGP

SEQ ID NO: 547 - protein, 462 aa, Homo sapiens; identical to SEQ ID NO: 545

SEQ ID NO: 548 - protein, 581 aa, Homo sapiens
MLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCLSRQGWEPQRP

SEQ ID NO: 549 - protein, 4347 aa, Homo sapiens [sequence omitted]

SEQ ID NO: 550 - protein, 4346 aa, Homo sapiens [sequence omitted]

SEQ ID NO: 551 - protein, 4391 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 552 - protein, 4346 aa, Homo sapiens [sequence omitted]

SEQ ID NO: 553 - protein, 364 aa, Homo sapiens [sequence omitted]

SEQ ID NO: 554 - protein, 364 aa, Homo sapiens [sequence omitted]

SEQ ID NO: 555 - protein, 313 aa, Homo sapiens
MQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 556 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 557 - protein, 827 aa, Homo sapiens
MLGGNLRMLGGNLRMLGENLRMLGRNLRELGGNLRKLGGNLRMLRVPGHGFPAPFRPSRKRSGSFRYLPLVHRKRVATRQVPARKKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 558 - protein, 731 aa, Homo sapiens
VRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 559 - protein, 732 aa, Homo sapiens
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 560 - protein, 2105 aa, Homo sapiens; identical to SEQ ID NO: 308

SEQ ID NO: 561 - protein, 589 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQISYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 562 - protein, 589 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 563 - protein, 545 aa, Homo sapiens
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 564 - protein, 589 aa, Homo sapiens; identical to SEQ ID NO: 562

SEQ ID NO: 565 - protein, 589 aa, Homo sapiens; identical to SEQ ID NO: 562

SEQ ID NO: 566 - protein, 536 aa, Homo sapiens
MGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 567 - protein, 658 aa, Homo sapiens
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 568 - protein, 684 aa, Homo sapiens
MVAPGAALSDLSPAPSGSGRQHKAVAMAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 569 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGRVKSIAATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 570 - protein, 957 aa, Homo sapiens; identical to SEQ ID NO: 569

SEQ ID NO: 571 - protein, 831 aa, Homo sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 572 - protein, 831 aa, Homo sapiens; identical to SEQ ID NO: 571

SEQ ID NO: 573 - protein, 697 aa, Homo sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGKWTGNHCL

SEQ ID NO: 574 - protein, 831 aa, Homo sapiens; identical to SEQ ID NO: 571

SEQ ID NO: 575 - protein, 831 aa, Homo sapiens; identical to SEQ ID NO: 571

SEQ ID NO: 576 - protein, 829 aa, Homo sapiens
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 577 - protein, 216 aa, Homo sapiens
MGCGSSPGTSELTLPLATPGQLSTASSADEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 578 - protein, 829 aa, Homo sapiens; identical to SEQ ID NO: 576

SEQ ID NO: 579 - protein, 572 aa, Homo sapiens
MAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 580 - protein, 572 aa, Homo sapiens; identical to SEQ ID NO: 579

SEQ ID NO: 581 - protein, 530 aa, Homo sapiens
MVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSESRRQRCSSGQLPTGLHNGLGRILQTAGRFLRTDVRAGAGPQPGAVGQRPRGQLSPQNHCQRKPICNRGFYICKPFDEELLFCSVKHYI

SEQ ID NO: 582 - protein, 572 aa, Homo sapiens; identical to SEQ ID NO: 579

SEQ ID NO: 583 - protein, 556 aa, Homo sapiens [sequence omitted]

SEQ ID NO: 584 - protein, 824 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGLNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 585 - protein, 513 aa, Homo sapiens
MESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 586 - protein, 227 aa, Homo sapiens
MFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 587 - protein, 227 aa, Homo sapiens; identical to SEQ ID NO: 586

SEQ ID NO: 588 - protein, 254 aa, Homo sapiens
MAEAVLRVARRQLSQRGGSGAPILLRQMFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 589 - protein, 101 aa, Homo sapiens
VPEAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 590 - protein, 698 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 591 - protein, 698 aa, Homo sapiens; identical to SEQ ID NO: 590

SEQ ID NO: 592 - protein, 424 aa, Homo sapiens
MGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 593 - protein, 571 aa, Homo sapiens
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 594 - protein, 278 aa, Homo sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 595 - protein, 271 aa, Homo sapiens
MPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 596 - protein, 294 aa, Homo sapiens
MERLTLTRTIGGPLLTATLLGKTTINDYQVIRMPFCHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 597 - protein, 269 aa, Homo sapiens
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 598 - protein, 153 aa, Homo sapiens
MKGVTCVSSIPLVLGRSQERPASPSMPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 599 - protein, 101 aa, Homo sapiens
MVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 600 - protein, 269 aa, Homo sapiens; identical to SEQ ID NO: 597

SEQ ID NO: 601 - protein, 367 aa, Homo sapiens [sequence omitted]

SEQ ID NO: 602 - protein, 1690 aa, Homo sapiens [sequence omitted]

SEQ ID NO: 603 - protein, 1685 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 604 - protein, 1688 aa, Homo sapiens [sequence omitted]

SEQ ID NO: 605 - protein, 1685 aa, Homo sapiens; identical to SEQ ID NO: 603

SEQ ID NO: 606 - protein, 1691 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGPTGFQGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 607 - protein, 349 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGLGSQSGEQGLAEGWPYPGRSLVPSLCLTFAFLLPAPFPFPS

SEQ ID NO: 608 - protein, 455 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 609 - protein, 452 aa, Homo sapiens
MAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 610 - protein, 740 aa, Homo sapiens
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALLPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKNPAFDDYPLGLQTVS

SEQ ID NO: 611 - protein, 740 aa, Homo sapiens
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKNPAFDDYPLGLQTVS

SEQ ID NO: 612 - protein, 105 aa, Homo sapiens
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 613 - protein, 104 aa, Homo sapiens
VKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 614 - protein, 85 aa, Homo sapiens
MVKQIESKTAFQEALDAAGDKLVVVDFSATWCGPCKMIKPFFHDVASECEVKCMPTFQFFKKGQKVGEFSGANKEKLEATINELV

SEQ ID NO: 615 - protein, 1997 aa, Homo sapiens [sequence omitted]

SEQ ID NO: 616 - protein, 2146 aa, Homo sapiens
AISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 617 - protein, 1997 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 618 - protein, 1997 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFKIISLDEERTVVLQTDPLPPARFGVSKEKTTSTGLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLSPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKRDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 619 - protein, 720 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 620 - protein, 720 aa, Homo sapiens; identical to SEQ ID NO: 619

SEQ ID NO: 621 - protein, 720 aa, Homo sapiens; identical to SEQ ID NO: 619

SEQ ID NO: 622 - protein, 720 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSDFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFSEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 623 - protein, 720 aa, Homo sapiens; identical to SEQ ID NO: 619

SEQ ID NO: 624 - protein, 401 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKFLYEYARRHPDYSVCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 625 - protein, 166 aa, Homo sapiens [sequence omitted]

SEQ ID NO: 626 - protein, 188 aa, Homo sapiens [sequence omitted]

SEQ ID NO: 627 - protein, 220 aa, Homo sapiens [sequence omitted]

SEQ ID NO: 628 - protein, 227 aa, Homo sapiens [sequence omitted]

SEQ ID NO: 629 - protein, 234 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKVLCKRIEKKSSLSNLILSILWLDLGNLSV

SEQ ID NO: 630 - protein, 221 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAACCQSSMNFGMKGRLRLPNRDSSVPVSKNLEKELSKHGQ

SEQ ID NO: 631 - protein, 218 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKSSMNFGMKGRLRLPNRDSSVPVSKNLEKELSKHGQ

SEQ ID NO: 632 - protein, 182 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPIRGPEPVMCVA

SEQ ID NO: 633 - protein, 784 aa, Homo sapiens
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 634 - protein, 860 aa, Homo sapiens
MLLPTPAPAPAPAPSRARAPSPAAPPIRSGPARHRPLALGPGGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 635 - protein, 769 aa, Homo sapiens
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILAPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 636 - protein, 834 aa, Homo sapiens
MLLPTPAPAPAPAPSRARAPSPAAPPIRSGPARHRPLALGPGGGAGGAAVPSQARAGRVPIACCAPGRAAPLGLLAMDADDSRAPKGSLRKFLEHLSGAGKAIGVLTSGGDAQGMNAAVRAVVRMGIYVGAKVYFIYEGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 637 - protein, 784 aa, Homo sapiens; identical to SEQ ID NO: 633

SEQ ID NO: 638 - protein, 923 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRENRGLEELAVSVGVDGTLYKLHPRFSSLVAATVRELAPRCVVTFLQSEDGSGKGAALVTAVACRLAQLTRV

SEQ ID NO: 639 - protein, 923 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSLSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRGNRGLEELAVSVGVDGTLYKLHPRFSSLVAATVRELAPRCVVTFLQSEDGSGKGAALVTAVACRLAQLTRV

SEQ ID NO: 640 - protein, 923 aa, Homo sapiens; identical to SEQ ID NO: 638

SEQ ID NO: 641 - protein, 357 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEE

SEQ ID NO: 642 - protein, 1125 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVVQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQEGTGRGGGAGQGGRPALCRGREGLGPTRAIACGPHAALGAGADAGQAGAGPQPVCHLPGEAQDHQPGDPRHAGGRGGAQGPRGAAQGGPGRAGHPPGARGHQGLSEEAAGPGRGTAAHVRRPAG

SEQ ID NO: 643 - protein, 1235 aa, Homo sapiens
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVVQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQEGTGRGGGAGQGGRPALCRGREGLGPTRAIACGPHAALGAGADAGQAGAGPQPVCHLPGEAQDHQPGDPRHAGGRGGAQGPRGAAQGGPGRAGHPPGARGHQGLSEEAAGPGRGTAAHVRRPAG

SEQ ID NO: 644 - protein, 422 aa, Homo sapiens
RPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSGHTCFTLTGLLGTLVTMGLLT

SEQ ID NO: 645 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 646 - protein, 507 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAAPTRSTPVSRTTKHFHETTPNKGSGTTSGTTRLLSGHTCFTLTGLLGTLVTMGLLT

SEQ ID NO: 647 - protein, 363 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 648 - protein, 321 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRATRSTPVSRTTKHFHETTPNKGSGTTSGTTRLLSGHTCFTLTGLLGTLVTMGLLT

SEQ ID NO: 649 - protein, 530 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSALIMHMRATKYSMLCLTI

SEQ ID NO: 650 - protein, 317 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNQKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 651 - protein, 440 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 652 - protein, 381 aa, Homo sapiens; identical to SEQ ID NO: 645

SEQ ID NO: 653 - protein, 376 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRFTEYGSNVLWWKYELDQDCRIKWSLIYCSQGFSY

SEQ ID NO: 654 - protein, 316 aa, Homo sapiens
SVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAAPTRSTPVSRTTKHFHETTPNKGSGTTSGTTRLLSGHTCFTLTGLLGTLVTMGLLT

SEQ ID NO: 655 - protein, 440 aa, Homo sapiens; identical to SEQ ID NO: 651

SEQ ID NO: 656 - protein, 419 aa, Homo sapiens
RPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSALIMHMRATKYSMLCLTI

SEQ ID NO: 657 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVTCLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 658 - protein, 533 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSGHTCFTLTGLLGTLVTMGLLT

SEQ ID NO: 659 - protein, 250 aa, Homo sapiens
MNARPHKVDGRVVEPKRAVSREDSQRPDAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQVAMAVPAAAVAMAVAEDFN

SEQ ID NO: 660 - protein, 268 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGSSSSSSYGSGRRF

SEQ ID NO: 661 - protein, 195 aa, Homo sapiens
SKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGR

SEQ ID NO: 662 - protein, 321 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKTVIQKYHTVNGHNCEVRKALSKQEMASASSSQRGRSGSGNFGGGRGGGFGGNDNFGRGGNFSGRGGFGGSHGGGGYGGSGDGYNGFGNDGSNFGGGGSYNDFGNYNNQSSNFGPMKGGNFGGRSSGPYGGGGQYFAKPRNQVAMAVPAAAVAMAVAEDFN

SEQ ID NO: 663 - protein, 319 aa, Homo sapiens
MRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 664 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPDAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFEGRSSGPHGGGGQYFAKPRNQGGYGGSSSSSSYGSGRRF

SEQ ID NO: 665 - protein, 372 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 666 - protein, 371 aa, Homo sapiens
SKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGRGFGGGSGSNFGGGGSYNDFGNYNNQSSNFGPMKGGNFGGRSSGPYGGGGQYFAKPRNQGGYGGSSSSSSYGSGRRF

SEQ ID NO: 667 - protein, 372 aa, Homo sapiens; identical to SEQ ID NO: 665

SEQ ID NO: 668 - protein, 567 aa, Homo sapiens [sequence omitted]

SEQ ID NO: 669 - protein, 117 aa, Homo sapiens [sequence omitted]

SEQ ID NO: 670 - protein, 444 aa, Homo sapiens
LSAHGRRRRSIVKVSLLPSVMSKSKSPKEPEQQRKLFIGGLSFETTDESLRSHCEQWGMLTDCVVMRDPNFKRSRGCGFVTYATVEEVDAAMNARPHKVDGRVVEPKRAVSREDSQRPGAHLTVKKIFVGGIKEDTEEHHLRDYFEQKIEVTEIMTDQGSGKKRGFAFVTFDDHDSVDKLVIQKYHTVNGHNCEVRKALSKQEMATGFIQPKRTKWFWKLWWWSWTWFQWEQLWSKKLQSWWFWWRLWWWWWIWWRGDGYNGFGNDGSNFAGGGSYNDFGNYNNQSSNFGPMKGGNFGGRSSGPYDGGGQYFAKPNQGGYGGSSSSSSCGSGRRFKLGNKAQERRAREVPGKLQVTTDLTQPSTVVAGPSCYNEDMFTNTHVYGQKTRELYLRLIVQVILVSVLRKVSILTKGFKCRFFFAPMLLIAKYNSLIVMLNKGLFLKK

SEQ ID NO: 671 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 672 - protein, 445 aa, Homo sapiens
MNARPHKVDGRVVEPKRAVSREDSQRPDAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRMQGPELLFLKPLTATGPLQLNVRSSARGQSAMSLCGALQSVVNALRAVRTFLRCVDQDARWTSPHPPNQSVPPGAIQLTAAERTAPAEKGSIISLWQETAAQLWRGQLACSQLEQWGAATDASRPRDAPNRSLLLMGGFLLPCPGNLAALPAARVGWGWVWLLSWKESSIISANQRSGACRSCSQDSTMAGFLGSTDFVLDYFLSEVVGCKFGTAEGHGYSLSLKVEETHMAMIRDTDHCLETSGTKSQLPQLENGLCLFCASHYEAEEPGFDKGPLEDQLRSMLYRTPSTRLWSGTTVVAALPPASSSSLLVLSPQPCH

SEQ ID NO: 673 - protein, 302 aa, Homo sapiens
VVSRATAEEALHWRVKLNSEPEEPFAVGNAHGLCGHERSKHQVLQGLWVCHICHCGGGRCSHERKATQGGWKSCGTKERSQEKILKEQVPILKRYLLVALMKTLKNIIEIILNSLEILKLKSLTKAVTKKRGFAFVTFDDHDSMDKTVIQKYHTVNGHNCEVRKALSKEMASVHPAKEVEVVPETLVVVMEVFSVGMTTLVMEETSMVVVALVAAIVVVDTVAVGMAIMDLVMMEAILEVVEATMILAIATITLQILDPREETLDAEALALMVVEANTLPNHETKVVMAVPVEAVAMAVAEN

SEQ ID NO: 674 - protein, 372 aa, Homo sapiens; identical to SEQ ID NO: 665

SEQ ID NO: 675 - protein, 439 aa, Homo sapiens
SIIKVSFPLLSCLSQSLLKSLNSGSSLLEGALKQPMRAGAILSNGNAHELCGNERPKHQVLQGLWVCHICHCGGGGCSHECRATQGGWKSCGTKESCFKRKFSNTRCPLNCEKAICWHRRPRTSPKRLFTVWEKNEATVIMTDRGSGRKRGFVFVTFDDHDSVDKTVIQKYHTVNGHNCEVRKALSKQEEMASASSSQRGRSGSGNFGGGRGGGFGGKDNFGCGGNFSGCGGFGGSHGGGGYGGSGDGYNRFGNDGSNFGGGGSYNDFGNYNNQSSNFGLSQAWWLTPVIPALWEAEVGGSPEVRSSTAAWPMQTPSLLKIQKISRAWRSPVVPATREAEAGEWREPGRRSLQAEIAPLHSSLGDRARLRLKKKKKKKKNLDPREETLEAEALAPMVVEANTLLIMKPRWLWWFQQQLWQQQQILITARKQSLAEESQR

SEQ ID NO: 676 - protein, 433 aa, Homo sapiens [sequence omitted]

SEQ ID NO: 677 - protein, 320 aa, Homo sapiens; identical to SEQ ID NO: 671

SEQ ID NO: 678 - protein, 308 aa, Homo sapiens
MSKSEFHKEPEQLRKLFIGGLSFETTDECLRSHFEQWGKLTDCVIMRDPNTKHSGFGFVTNATVEEVDAAMNARSHKVDERVVEPKGADSREDSQPGAHLTVKKIFVGGIKEDTEEHHLKDYVIEIMTDRGRGRETGFAFVTFDEHDSMNKTVIQKYHTVNGHNCEVRKALSKQEMASVSSSQRGSGSGNFGGGCGGDFGGNDNFVHGGNFSGSGGFGGNCVGGGYGGSEDGYNGYGKNGSNFGHGGSYNDFDNYNNQSSNFGPMKGNFGGRSSGPYGGGDQYVAKPQNQGGSGGFSSGSSYGCGRRF

SEQ ID NO: 679 - protein, 555 aa, Homo sapiens
FFFLPMDTAEEALLKSLFTLPSCLSQSLLKSPNSGSSSLEGALKQPMRALRSHFEQWGMLTDCVVMRDPNTKHPRGFGFVTYATVEEVDAAMNARPHKVDGRVVEPKRAVSREDSERPGAHLTVKKIFVGGIKEDTEEHHLRDDFEQYGKIEVIEIMTDRGSGKKRGFAFVNFDDHDSMDKIVIQKYHTVNGHNCEVRKAPSQQEMDSASSSQRGRSGSGNFGGGRGGGFGGNDNFGHGGNFSGCGGFGGSHGGGGYGGSGDGYNGFGNDGSDFGGGGSYNDFGNYNNQSSNFGPMKGGNFGGRSSGPYGGGGQYFAKPQNQGGYGGSSSSGSYGSGRRFLGNKAQERRAREVTGKLQVTTDLTQPSTVVAGPSCYKEDMFTNTHVYGQKTRGLYLLIVQVILVSVLWKVSIPTKGFNVDFFFAPMLLIANVIVSCINVFSFCAVSSTLKPSWISPTVSNSFRVMPGSIWNLYTTCLEGEAIVFRNLGVVELIVTVVTSSPLKGITQAKSWNYWLKLLAHPMQYIIEWYIKLMGMKLVYHPLSCVINKFNSLEKN

SEQ ID NO: 680 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGHGGNFSGRGGFGGSRAGGRYGGSGDGSNGFGNDGSNFGGGGSYNDFGNYNNQSSNFGPMKGGNFGGRNSGPYGGGGQYFAKPRNQGGYGGSSSSSSCVSGRRF

SEQ ID NO: 681 - protein, 320 aa, Homo sapiens; identical to SEQ ID NO: 680

SEQ ID NO: 682 - protein, 239 aa, Homo sapiens
GSGKKRGFAFVTFDDHDSVDKIVIPKYHTVNGHNCEVRKALSKQEMASASSSQRGRSGRGGGFGGNENFGCGGNFSGHGGFGGSHDGGGYGGSGDGYNGFGNDGGYPGGGPGYSGGSRGYGSGGQGCGNQDSGYGRSGSYDSCNKGGRGGFGSGSGSNFGGGGSYNDFGNYNNQYSNFGPMKGGNFGADALAPRVMEANTLPNHQTTVAMAVPVAAVAMAVAEDVNWESKLSRRGEPEK

SEQ ID NO: 683 - protein, 436 aa, Homo sapiens [sequence omitted]

SEQ ID NO: 684 - protein, 228 aa, Homo sapiens
MEAPQDRPIIVFVVDLSPVVLAFTSICCLSLCLLGALAILWQLRKLFIGELRFETTDESLRSHFERWGMLTDCAVMRDPNTKRSRGFGFVTYATVEEKRGFAFVTFDDHDSMDKIVIPKYHTVNGHNCEVRKALSKQEMASASSSQRGQSGSGNFGGGCGGGFCGNDNFGHGGNVSGRGGFGGSHGGGGYGGSGDGYNGFGNDGSNLEVVEATMILAITTVSLQILDP

SEQ ID NO: 685 - protein, 317 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRGYGGSSSSSSYGSGRRF

SEQ ID NO: 686 - protein, 168 aa, Homo sapiens [sequence omitted]

SEQ ID NO: 687 - protein, 543 aa, Homo sapiens [sequence omitted]

SEQ ID NO: 688 - protein, 701 aa, Homo sapiens [sequence omitted]

SEQ ID NO: 689 - protein, 440 aa, Homo sapiens [sequence omitted]

SEQ ID NO: 690 - protein, 700 aa, Homo sapiens
MAGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGVRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 691 - protein, 696 aa, Homo sapiens
MAGIAAKLAKDREAAEGLGSHDRAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 692 - protein, 699 aa, Homo sapiens
AGIAAKLAKDREAAEGLGSHERAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGVRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 693 - protein, 700 aa, Homo sapiens
MAGIAAKLAKDREAAEGLGSHERAIKYLNQDYEALRNECLEAGTLFQDPSFPAIPSALGFKELGPYSSKTRGMRWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGVRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 694 - protein, 96 aa, Homo sapiens
KPLVLHCTCPRGQGAQRRRGDCGPRAGGRWQVALCRDRRGHQGPGCQALREGSDEAHVDQKNKVVTTPAFMCETALHYIHDGIGAMVRKVLELTGK

SEQ ID NO: 695 - protein, 111 aa, Homo sapiens [sequence omitted]

SEQ ID NO: 696 - protein, 111 aa, Homo sapiens [sequence omitted]

SEQ ID NO: 697 - protein, 268 aa, Homo sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 698 - protein, 167 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCVSIPDVVGWFVLFYKPGIVLLLALAKYLKMNNFL

SEQ ID NO: 699 - protein, 304 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 700 - protein, 304 aa, Homo sapiens; identical to SEQ ID NO: 699

SEQ ID NO: 701 - protein, 304 aa, Homo sapiens; identical to SEQ ID NO: 699

SEQ ID NO: 702 - protein, 304 aa, Homo sapiens; identical to SEQ ID NO: 699

SEQ ID NO: 703 - protein, 304 aa, Homo sapiens; identical to SEQ ID NO: 699

SEQ ID NO: 704 - protein, 761 aa, Homo sapiens [sequence omitted]

SEQ ID NO: 705 - protein, 857 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 706 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 707 - protein, 1119 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPELPADTTATVEDMLPSVTTVTTNSDTITETFATAQNSPTSETTTLTSSIAPPATATPDSNSVPAGQATPSKGPSASAPSPAPASAPKVAPLVDLSDTPTSTPAASNLSSSVLANQGAVLSPSAPAGVGEASKAPPASKPTPAPVPTPTGAASPLAAAAAPATEAPQAKQEAPSTKGPDPEPTQPGAAKSPAEAATALASPKSEAASVSTTNPSQGEDFKMDEGNFKTPDIDLAKDVFAALGSPAPAAGASGQAPELAPSTADSSVSPAPAKTEKGPVEAKPECQETETKPAPAEVKTVPNDATQTKENESKA

SEQ ID NO: 708 - protein, 847 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 709 - protein, 761 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 710 - protein, 650 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVPASASSSTPVPLSPPDTTWPLPALATTEPAKNIAQNHCCNMFQAGLHNALMK

SEQ ID NO: 711 - protein, 844 aa, Homo sapiens
NSFICFTSQQKVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPELPADTTATVEDMLPSVTTVTTNSDTITETFATAQNSPTRRAP

SEQ ID NO: 712 - protein, 605 aa, Homo sapiens [sequence omitted]

SEQ ID NO: 713 - protein, 615 aa, Homo sapiens [sequence omitted]

SEQ ID NO: 714 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 715 - protein, 1018 aa, Homo sapiens [sequence omitted]

SEQ ID NO: 716 - protein, 1072 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEGEYPGSNSRSHI

SEQ ID NO: 717 - protein, 1065 aa, Homo sapiens; identical to SEQ ID NO: 714

SEQ ID NO: 718 - protein, 173 aa, Homo sapiens
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTHWRRHGHDHQGRPSLPGPRVCSVPPHRHIWCWLSHYGRMSWRGRHSH

SEQ ID NO: 719 - protein, 664 aa, Homo sapiens
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 720 - protein, 664 aa, Homo sapiens; identical to SEQ ID NO: 719

SEQ ID NO: 721 - protein, 664 aa, Homo sapiens; identical to SEQ ID NO: 719

SEQ ID NO: 722 - protein, 530 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 723 - protein, 100 aa, Homo sapiens
MFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 724 - protein, 530 aa, Homo sapiens; identical to SEQ ID NO: 722

SEQ ID NO: 725 - protein, 117 aa, Homo sapiens
LQLPLFSHLQHNVSNSLTCLTLKQEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 726 - protein, 524 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 727 - protein, 373 aa, Homo sapiens
MQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 728 - protein, 367 aa, Homo sapiens
MQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 729 - protein, 524 aa, Homo sapiens; identical to SEQ ID NO: 726

SEQ ID NO: 730 - protein, 530 aa, Homo sapiens; identical to SEQ ID NO: 722

SEQ ID NO: 731 - protein, 373 aa, Homo sapiens; identical to SEQ ID NO: 727

SEQ ID NO: 732 - protein, 373 aa, Homo sapiens; identical to SEQ ID NO: 727

SEQ ID NO: 733 - protein, 855 aa, Homo sapiens [sequence omitted]

SEQ ID NO: 734 - protein, 855 aa, Homo sapiens [sequence omitted]

SEQ ID NO: 735 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 736 - protein, 774 aa, Homo sapiens [sequence omitted]

SEQ ID NO: 737 - protein, 388 aa, Homo sapiens
  VARIANT (1)...(388): Xaa = Any Amino Acid
MPPFWEAPPWANQSRARELEFVLLGFAHVPSLRPMLAALFLAAFLLTMSGNSLIVLLTSLDFGLRTPMYFFLRQLALVEICFSLDVAPRLLVTLLQPGRGVSPTSCALQLLLVLSCVTSECFLLMVMAWDRFLAICRPLRYGAIMSPQLCYLLATTCWLAGIPVALVFTIWLFNFPFCGPRGIRHFFCDIAPLLSLVCADTRVFEANVFXXXXXXXXXXXXXXXXXXXXXXXXXXXXXXXXXXLSSCFAHSRHMLQVSCQRNIASAATNSGYDITRCFAGTAFAGYSPASTDAVQIEAVLFVKFNYARCETSGAGKRLIRRIAVNDVTITCQRERAPEACIHEYACPTLKKTVQVVTNQAVEAVPIEVKECCCTLDRIQPLRVECFTN

SEQ ID NO: 738 - protein, 362 aa, Homo sapiens
MLVMAPRTVLLLLSAALALTETWAGSHSMRYFYTAVSRPGRGEPRFISVGYVDDTQFVRFDSDAASPREEPRAPWIEQEGPEYWDRNTQICKTNTQTDRESLRNLRGYYNQSEAGSHTLQWMYGCDVGPDGRLLRGYNQFAYDGKDYIALNEDLSSWTAADTAAQITQRKWEAAREAEQLRAYLEGTCVEWLRRHLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAASSDSAQGSDVSLTA

SEQ ID NO: 739 - protein, 365 aa, Homo sapiens [sequence omitted]

SEQ ID NO: 740 - protein, 362 aa, Homo sapiens [sequence omitted]

SEQ ID NO: 741 - protein, 362 aa, Homo sapiens [sequence omitted]

SEQ ID NO: 742 - protein, 366 aa, Homo sapiens [sequence omitted]

SEQ ID NO: 743 - protein, 362 aa, Homo sapiens [sequence omitted]

SEQ ID NO: 744 - protein, 323 aa, Homo sapiens [sequence omitted]

SEQ ID NO: 745 - protein, 372 aa, Homo sapiens [sequence omitted]

SEQ ID NO: 746 - protein, 366 aa, Homo sapiens
MRVMAPRTLILLLSGALALTETWAGSHSMRYFSTSVSWPGRGEPRFIAVGYVDDTQFVRFDSDAASPRGEPREPWVEQEGPEYWDRETQKYKRQAQADRVNLRKLRGYYNQSEDGSHTLQRMFGCDLGPDGRLLRGYNQFAYDGKDYIALNEDLRSWTAADTAAQITQRKWEAAREAEQRRAYLEGTCVEWLRRYLENGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWKPSSQPTIPIVGIVAGLAVLAVLAVLGAMVAVVMCRRKSSGGKGGSCSQAASSNSAQGSDESLIACKA

SEQ ID NO: 747 - protein, 362 aa, Homo sapiens [sequence omitted]

SEQ ID NO: 748 - protein, 362 aa, Homo sapiens
MRVTAPRTLLLLLWGAVALTETWAGSHSMRYFHTSVSRPGRGEPRFISVGYVDGTQFVRFDSDAASPRTEPRAPWIEQEGPEYWDRNTQISKTNTQTYRESLRNLRGYYNQSEAGSHTLQRMYGCDVGPDGRLLRGHDQSAYDGKDYIALNEDLSSWTAADTAAQITQRKWEAARVAEQLRAYLEGTCVEWLRRHLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 749 - protein, 362 aa, Homo sapiens [sequence omitted]

SEQ ID NO: 750 - protein, 222 aa, Homo sapiens [sequence omitted]

SEQ ID NO: 751 - protein, 287 aa, Homo sapiens [sequence omitted]

SEQ ID NO: 752 - protein, 365 aa, Homo sapiens
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRESLRIALRYYNQSEAGSHTIQMMYGCDVGPDGRLLRGYQQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAMFAGAVVAAVRWRRKSSDRKGGSYSQAASSDSAQGSDMSLTACKV

SEQ ID NO: 753 - protein, 243 aa, Homo sapiens [sequence omitted]

SEQ ID NO: 754 - protein, 366 aa, Homo sapiens [sequence omitted]

SEQ ID NO: 755 - protein, 345 aa, Homo sapiens [sequence omitted]

SEQ ID NO: 756 - protein, 366 aa, Homo sapiens [sequence omitted]

SEQ ID NO: 757 - protein, 366 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGGKGGSCSQAASSNSAQGSDESLIACKA

SEQ ID NO: 758 - protein, 365 aa, Homo sapiens [sequence omitted]

SEQ ID NO: 759 - protein, 362 aa, Homo sapiens [sequence omitted]

SEQ ID NO: 760 - protein, 389 aa, Homo sapiens [sequence omitted]

SEQ ID NO: 761 - protein, 362 aa, Homo sapiens
MLVMAPRTVLLLLSAALALTETWAGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 762 - protein, 365 aa, Homo sapiens [sequence omitted]

SEQ ID NO: 763 - protein, 366 aa, Homo sapiens
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGGKGGSCSQAASSNSAQGSDESLIACKA

SEQ ID NO: 764 - protein, 362 aa, Homo sapiens [sequence omitted]

SEQ ID NO: 765 - protein, 326 aa, Homo sapiens [sequence omitted]

SEQ ID NO: 766 - protein, 362 aa, Homo sapiens [sequence omitted]

SEQ ID NO: 767 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 768 - protein, 362 aa, Homo sapiens
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 769 - protein, 326 aa, Homo sapiens [sequence omitted]

SEQ ID NO: 770 - protein, 365 aa, Homo sapiens [sequence omitted]

SEQ ID NO: 771 - protein, 365 aa, Homo sapiens [sequence omitted]

SEQ ID NO: 772 - protein, 366 aa, Homo sapiens
MRVMAPRTLILLLSGALALTETWACSHSMRYFSTSVSRPGRGEPRFIAVGYVDDTQFVRFDSDAASPRGEPRAPWVEQEGPEYWDRETQKYKRQAQTDRVSLRNLRGYYNQSEAGSHTLQWMFGCDLGPDGRLLRGYDQSAYDGKDYIALNEDLRSWTAADTAAQITQRKWEAAREAEQRRAYLEGTCVEWLRRYLENGKESLQRAEHPKTHVTHHPVSDHEATLRCWALGFYPAEITLTWQWDGEDQTQDTELVETRPAGDGTFQKWAAVMVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 773 - protein, 366 aa, Homo sapiens [sequence omitted]

SEQ ID NO: 774 - protein, 366 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQADRVSLRNLRGYYNQSEAGSHTLQRMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGGKGGSCSQAASSNSAQGSDESLIACKA

SEQ ID NO: 775 - protein, 366 aa, Homo sapiens
MRVMAPRTLILLLSGALALTETWACSHSMKYFFTSVSRPGRGEPRFISVGYVDDTQFVRFDSDAASPRGEPRAPWVEQEGPEYWDRETQKYKRQAQTDRVSLRNLRGYYNQSEAGSHTLQWMCGCDLGPDGRLLRGYDQYAYDGKDYIALNEDLRSWTAADTAAQITQRKWEAAREAEQRRAYLEGTCVEWLRRYLENGKETLQRAEHPKTHVTHHPVSDHEATLRCWALGFYPAEITLTWQWDGEDQTQDTELVETRPAGDGTFQKWAAVMVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 776 - protein, 273 aa, Homo sapiens
SHSMRYFYTSVSRPGRGEPRFIAVGYVDDTQFVRFDSDAASQRMEPRAPWIEQEGPEYWDRNTRNVKAQSQTDRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRW

SEQ ID NO: 777 - protein, 362 aa, Homo sapiens [sequence omitted]

SEQ ID NO: 778 - protein, 368 aa, Homo sapiens [sequence omitted]

SEQ ID NO: 779 - protein, 374 aa, Homo sapiens [sequence omitted]

SEQ ID NO: 780 - protein, 366 aa, Homo sapiens [sequence omitted]

SEQ ID NO: 781 - protein, 366 aa, Homo sapiens [sequence omitted]

SEQ ID NO: 782 - protein, 366 aa, Homo sapiens [sequence omitted]

SEQ ID NO: 783 - protein, 275 aa, Homo sapiens
VKAQSQTHRVDLGTLRGYYNQSEAVSHTVQRMYGCDVGSDGRFLRGYHQVAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGEEQRYTCHVQHEGLPKPLTLRWEPSSQPTIPIVGIIAGLVLLGAVITGAVVAAVMWRRKSSDRKGGSYSQAASSDSAQGSDVSLTACKV

SEQ ID NO: 784 - protein, 362 aa, Homo sapiens [sequence omitted]

SEQ ID NO: 785 - protein, 365 aa, Homo sapiens [sequence omitted]

SEQ ID NO: 786 - protein, 366 aa, Homo sapiens [sequence omitted]

SEQ ID NO: 787 - protein, 365 aa, Homo sapiens [sequence omitted]

SEQ ID NO: 788 - protein, 365 aa, Homo sapiens [sequence omitted]

SEQ ID NO: 789 - protein, 288 aa, Homo sapiens [sequence omitted]

SEQ ID NO: 790 - protein, 366 aa, Homo sapiens [sequence omitted]

SEQ ID NO: 791 - protein, 366 aa, Homo sapiens [sequence omitted]

SEQ ID NO: 792 - protein, 362 aa, Homo sapiens [sequence omitted]

SEQ ID NO: 793 - protein, 102 aa, Homo sapiens [sequence omitted]

SEQ ID NO: 794 - protein, 301 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIKF

SEQ ID NO: 795 - protein, 303 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 796 - protein, 303 aa, Homo sapiens; identical to SEQ ID NO: 795

SEQ ID NO: 797 - protein, 218 aa, Homo sapiens
MVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 798 - protein, 164 aa, Homo sapiens
MRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 799 - protein, 256 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 800 - protein, 256 aa, Homo sapiens; identical to SEQ ID NO: 799

SEQ ID NO: 801 - protein, 169 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQELKAA

SEQ ID NO: 802 - protein, 218 aa, Homo sapiens; identical to SEQ ID NO: 797

SEQ ID NO: 803 - protein, 256 aa, Homo sapiens; identical to SEQ ID NO: 799

SEQ ID NO: 804 - protein, 256 aa, Homo sapiens; identical to SEQ ID NO: 799

SEQ ID NO: 805 - protein, 106 aa, Homo sapiens
MRAYWPDVIHSFPNRSRFWKHEWEKHGTCAAQVDALNSQKKYFGRSLELYRELDLNRWVRPSPGCTSQWGSLLSPKPDSWIQGSGCRPHCPPAASACALFGYWDHS

SEQ ID NO: 806 - protein, 416 aa, Homo sapiens
MLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 807 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 808 - protein, 683 aa, Homo sapiens; identical to SEQ ID NO: 807

SEQ ID NO: 809 - protein, 683 aa, Homo sapiens; identical to SEQ ID NO: 807

SEQ ID NO: 810 - protein, 199 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 811 - protein, 199 aa, Homo sapiens; identical to SEQ ID NO: 810

SEQ ID NO: 812 - protein, 179 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGGTGRGAGSCHPGGQRLGWALLTRQKGLFSGSLQRKRGVFVFHGALGHIGGWNGEGYGNEQ

SEQ ID NO: 813 - protein, 194 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGM

SEQ ID NO: 814 - protein, 171 aa, Homo sapiens
MCVLCRKQEASALNLLQRARGSRAGTSSPQPPPPIGMANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGL

SEQ ID NO: 815 - protein, 220 aa, Homo sapiens
MSAFSLALALVSSPQPPPPIGMANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 816 - protein, 917 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 817 - protein, 917 aa, Homo sapiens; identical to SEQ ID NO: 816

SEQ ID NO: 818 - protein, 917 aa, Homo sapiens; identical to SEQ ID NO: 816

SEQ ID NO: 819 - protein, 663 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 820 - protein, 663 aa, Homo sapiens; identical to SEQ ID NO: 819

SEQ ID NO: 821 - protein, 129 aa, Homo sapiens
REGFVCQTETQVCQAVARLSQRFPKAEFAEVSKLVTDLTKVHTECCHGDLLECADDRADLAKYICENQDSISSKLKECCEKPLLEKSHCIAELKVRMFAKTMLRQRMSSWACFCMNMQEGILITLSCCC

SEQ ID NO: 822 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 823 - protein, 687 aa, Homo sapiens; identical to SEQ ID NO: 822

SEQ ID NO: 824 - protein, 687 aa, Homo sapiens; identical to SEQ ID NO: 822

SEQ ID NO: 825 - protein, 687 aa, Homo sapiens; identical to SEQ ID NO: 822

SEQ ID NO: 826 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 827 - protein, 315 aa, Homo sapiens
ASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 828 - protein, 316 aa, Homo sapiens; identical to SEQ ID NO: 826

SEQ ID NO: 829 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 830 - protein, 364 aa, Homo sapiens
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 831 - protein, 364 aa, Homo sapiens; identical to SEQ ID NO: 829

SEQ ID NO: 832 - protein, 363 aa, Homo sapiens
PHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 833 - protein, 364 aa, Homo sapiens; identical to SEQ ID NO: 830

SEQ ID NO: 834 - protein, 364 aa, Homo sapiens; identical to SEQ ID NO: 829

SEQ ID NO: 835 - protein, 363 aa, Homo sapiens
PYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 836 - protein, 433 aa, Homo sapiens
MGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 837 - protein, 451 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 838 - protein, 450 aa, Homo sapiens [sequence omitted]

SEQ ID NO: 839 - protein, 451 aa, Homo sapiens [sequence omitted]

SEQ ID NO: 840 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 841 - protein, 418 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDLAALEKDYEEVGVDSVEAEAEEGEEY

SEQ ID NO: 842 - protein, 416 aa, Homo sapiens
MPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 843 - protein, 416 aa, Homo sapiens
MPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 844 - protein, 432 aa, Homo sapiens
MRECISIHVGQAGVQIGNACWELYCLEHGIQPDGQMPSDKTIGGGDDSFNTFFSETGAGKHVPRAVFVDLEPTVIGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 845 - protein, 448 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 846 - protein, 451 aa, Homo sapiens; identical to SEQ ID NO: 837

SEQ ID NO: 847 - protein, 451 aa, Homo sapiens; identical to SEQ ID NO: 837

SEQ ID NO: 848 - protein, 450 aa, Homo sapiens; identical to SEQ ID NO: 840

SEQ ID NO: 849 - protein, 451 aa, Homo sapiens [sequence omitted]

SEQ ID NO: 850 - protein, 448 aa, Homo sapiens; identical to SEQ ID NO: 845

SEQ ID NO: 851 - protein, 383 aa, Homo sapiens [sequence omitted]

SEQ ID NO: 852 - protein, 385 aa, Homo sapiens
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 853 - protein, 385 aa, Homo sapiens; identical to SEQ ID NO: 852

SEQ ID NO: 854 - protein, 388 aa, Homo sapiens [sequence omitted]

SEQ ID NO: 855 - protein, 256 aa, Homo sapiens
SSRTRLPKKAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 856 - protein, 432 aa, Homo sapiens
MVSISRPRDPPALASQSAGITGVSLRARPPPRPAGYVFRKEFPVCAGAATRARCPGPCSGTWVGALSVPTPWSQPRVSLGRNIARRGLWVPSALAQGPPAASEGCLPEGGAFPKGPPQQALGSSLPGGVARSSPWASGPRGVRATVYFWDENQSFPGRSRRFLGVRQAARAVLLHSADRVSPGLAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 857 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 858 - protein, 269 aa, Homo sapiens; identical to SEQ ID NO: 857

SEQ ID NO: 859 - protein, 269 aa, Homo sapiens; identical to SEQ ID NO: 857

SEQ ID NO: 860 - protein, 1474 aa, Homo sapiens [sequence omitted]

SEQ ID NO: 861 - protein, 3420 aa, Homo sapiens
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTLAQNLKNKASSSDMRTAITEKLERVKNQWDGTQHGVELRQQQLEDMIIDSLQWDDHREETEELMRKYEARLYILQQARRDPLTKQISDNQILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 862 - protein, 3445 aa, Homo sapiens [sequence omitted]

SEQ ID NO: 863 - protein, 3433 aa, Homo sapiens
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVRLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTLAQNLKNKASSSDMRTAITEKLERVKNQWDGTQHGVELRQQQLEDMIIDSLQWDDHREETEELMRKYEARLYILQQARRDPLTKQISDNQILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 864 - protein, 3378 aa, Homo sapiens
MFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTLAQNLKNKASSSDMRTAITEKLERVKNQWDGTQHGVELRQQQLEDMIIDSLQWDDHREETEELMRKYEARLYILQQARRDPLTKQISDNQILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 865 - protein, 524 aa, Homo sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRRTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 866 - protein, 524 aa, Homo sapiens [sequence omitted]

SEQ ID NO: 867 - protein, 524 aa, Homo sapiens; identical to SEQ ID NO: 865

SEQ ID NO: 868 - protein, 412 aa, Homo sapiens [sequence omitted]

SEQ ID NO: 869 - protein, 524 aa, Homo sapiens
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRRTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFNQENIKERSPLAFIPFSAGPRNCIGQAFAMAEMKVVLALTLLHFRILPTHIEPRRKPELILRAEGGLWLRVEPLGANSQ

SEQ ID NO: 870 - protein, 149 aa, Homo sapiens
MKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 871 - protein, 165 aa, Homo sapiens
ASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 872 - protein, 137 aa, Homo sapiens
MKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLG

SEQ ID NO: 873 - protein, 149 aa, Homo sapiens; identical to SEQ ID NO: 870

SEQ ID NO: 874 - protein, 166 aa, Homo sapiens
MASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 875 - protein, 166 aa, Homo sapiens; identical to SEQ ID NO: 874

SEQ ID NO: 876 - protein, 166 aa, Homo sapiens; identical to SEQ ID NO: 874

SEQ ID NO: 877 - protein, 316 aa, Homo sapiens
MATFVELSTKAKMPIVGLGTWRSLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 878 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 879 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFDAEY

SEQ ID NO: 880 - protein, 248 aa, Homo sapiens
MREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 881 - protein, 416 aa, Homo sapiens [sequence omitted]

SEQ ID NO: 882 - protein, 344 aa, Homo sapiens
MVLQMEPQVNSTNNFHQGPLDQPVGPLTGLKSSLLKDTTSAGPLLRPYPASLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 883 - protein, 244 aa, Homo sapiens
YFYENQHEVGEAIQEKIQEKAVMREDLFIVSKVWPTFFERPLVRKAFEKTLKDLKLSYLDVYLIHWPQGFKAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 884 - protein, 561 aa, Homo sapiens [sequence omitted]

SEQ ID NO: 885 - protein, 522 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 886 - protein, 524 aa, Homo sapiens [sequence omitted]

SEQ ID NO: 887 - protein, 522 aa, Homo sapiens; identical to SEQ ID NO: 885

SEQ ID NO: 888 - protein, 522 aa, Homo sapiens; identical to SEQ ID NO: 885

SEQ ID NO: 889 - protein, 394 aa, Homo sapiens [sequence omitted]

SEQ ID NO: 890 - protein, 310 aa, Homo sapiens [sequence omitted]

SEQ ID NO: 891 - protein, 193 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTG

SEQ ID NO: 892 - protein, 4590 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGDIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTIMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNGNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKSASDADEGSNADITYAIEADSESVKENLEINKLSGVITTKESLIGLENEFFTFFVRAVDNGSPSKESVVLVYVKILPPEMQLPKFSEPFYTFTVSEDVPVGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVVTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 893 - protein, 3841 aa, Homo sapiens [sequence omitted]

SEQ ID NO: 894 - protein, 1614 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGTFGEILEILL

SEQ ID NO: 895 - protein, 3377 aa, Homo sapiens [sequence omitted]

SEQ ID NO: 896 - protein, 917 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRATLQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 897 - protein, 792 aa, Homo sapiens [sequence omitted]

SEQ ID NO: 898 - protein, 368 aa, Homo sapiens
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 899 - protein, 388 aa, Homo sapiens
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPLLPRSPTSRPAGRGGATLRCS

SEQ ID NO: 900 - protein, 368 aa, Homo sapiens; identical to SEQ ID NO: 898

SEQ ID NO: 901 - protein, 368 aa, Homo sapiens; identical to SEQ ID NO: 898

SEQ ID NO: 902 - protein, 368 aa, Homo sapiens; identical to SEQ ID NO: 898

SEQ ID NO: 903 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 904 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKANKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGT

SEQ ID NO: 905 - protein, 738 aa, Homo sapiens; identical to SEQ ID NO: 904

SEQ ID NO: 906 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 907 - protein, 134 aa, Homo sapiens
ACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 908 - protein, 2012 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 909 - protein, 2012 aa, Homo sapiens; identical to SEQ ID NO: 908

SEQ ID NO: 910 - protein, 2012 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKETSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 911 - protein, 2014 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEARVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 912 - protein, 155 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAVR

SEQ ID NO: 913 - protein, 532 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 914 - protein, 532 aa, Homo sapiens; identical to SEQ ID NO: 913

SEQ ID NO: 915 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 916 - protein, 723 aa, Homo sapiens
PEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 917 - protein, 724 aa, Homo sapiens; identical to SEQ ID NO: 915

SEQ ID NO: 918 - protein, 724 aa, Homo sapiens; identical to SEQ ID NO: 915

SEQ ID NO: 919 - protein, 240 aa, Homo sapiens
RDIFEKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 920 - protein, 257 aa, Homo sapiens
MFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 921 - protein, 200 aa, Homo sapiens [sequence omitted]

SEQ ID NO: 922 - protein, 257 aa, Homo sapiens; identical to SEQ ID NO: 920

SEQ ID NO: 923 - protein, 664 aa, Homo sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 924 - protein, 664 aa, Homo sapiens; identical to SEQ ID NO: 923

SEQ ID NO: 925 - protein, 647 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 926 - protein, 225 aa, Homo sapiens
MGFRDLKSPTGLQVLNDYLADKSYIKGYVPSQADVAVFEAVSGPPPADLCHALRWYNHIKSYEKEKAGLPGVKKALSKYGPADVEDTTGSGATDSKDDDDIDLFGSDYEEESEEAKRLREEHLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 927 - protein, 281 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 928 - protein, 281 aa, Homo sapiens; identical to SEQ ID NO: 927

SEQ ID NO: 929 - protein, 53 aa, Homo sapiens
VRSIQADGLVWGSSKLVPVGYRFKKLQIQCVVEDDKFGTDMLEEQIAAFQDYV

SEQ ID NO: 930 - protein, 225 aa, Homo sapiens; identical to SEQ ID NO: 926

SEQ ID NO: 931 - protein, 53 aa, Homo sapiens; identical to SEQ ID NO: 929

SEQ ID NO: 932 - protein, 225 aa, Homo sapiens
MGFRDLKSPAGLQVLNDYLADKSYIEGYVPSQADVAVFEAVSSPLPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEERVRSIQADGLVWGSSKLVPVGYGIKKLQIQCVVEDDKVGTDMLEEQITAFEDYVQSMDVAAFNKI

SEQ ID NO: 933 - protein, 623 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 934 - protein, 257 aa, Homo sapiens
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 935 - protein, 45 aa, Homo sapiens [sequence omitted]

SEQ ID NO: 936 - protein, 225 aa, Homo sapiens
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 937 - protein, 247 aa, Homo sapiens
ELSDTAKAMGFGDLKSPAGLQVLNDYLTDKSYIKGYVPSQADVAVFEAVPRPLPADLCHALCWYNHIKSYEKEKASLPGVKKALGKYGPADVEDTTGSGATDSKDDDDIDLSGSDDEEESEEAKRLREERLAQYESKKAKKPALVSKSSILLDVKSWDDETDMAKLEGVRSIQADVLVWDSSKLVPVGYRIKKLQIQCVVEDDKVGTDMLEEQITAFEDYVQPMDVAAFNKINPSWIMAFKKLERLK

SEQ ID NO: 938 - protein, 319 aa, Homo sapiens
  VARIANT (1)...(319): Xaa = Any Amino Acid
MDIESFHIYLHVNVGRYEMCPASADSSSLVVASLAGVRKMATNFLVHEKIWFDKFKYDDAERRFYEQMNGPVAGASRQENDASVILRDIARARENIQKSLAGNSGPGASSGPSGDHSELVVRITSLKVENQSLRSVVQELQQVISKLEARLNVLEKNSPGHRATAPQTQHMSPMRQVEPLAKKPFTPAEDDDDDDTDLFGSDNEEEDKKAAQLQEERLQQYAEKKAKKPELVAKSSILLDFKPWDDETDMAQLEACVCSIQLEELVXGASKLVPMGYGIRKLQIQCVVEDDKVGTDLLEEITKFEEHVQSVDIAAFNKI

SEQ ID NO: 939 - protein, 71 aa, Homo sapiens [sequence omitted]

SEQ ID NO: 940 - protein, 647 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 941 - protein, 257 aa, Homo sapiens; identical to SEQ ID NO: 934

SEQ ID NO: 942 - protein, 310 aa, Homo sapiens
MEDLEGPFINLPASADSSSLVAASLAGVRKMATNFLAHEKIWFDKFKYDDAERRFYQQMNRPVAGASRQENGASVILHDIVRARENIQKSLAGSSGPGASSGPSGDHSELVVRIASLEVENQSLRGVVQELQQAISKLEAQLNVLEKSSPGHRATAPQTQHVSPMRQVESPAKKPASPAEDDEDDDIDLFGSDNEEEDKEAAQLREERLRQYAEKAKKPALVAKSSILLDVKPWDDETDMAQLEACVRSIELDGLVWGTSKLMPVGYGIRKLQIQCVVEDDKVGTYLLEEEITKFEEHVQSVDIAAFNKI

SEQ ID NO: 943 - protein, 280 aa, Homo sapiens
MATNFLAHEKIWFDKFKYDDAERRFYQQMNRPVAGASRQENGASVILHDIVRARENIQKSLAGSSGPGASSGPSGDHSELVVRIASLEVENQSLRGVVQELQQAISKLEAQLNVLEKSSPGHRATAPQTQHVSPMRQVESPAKKPASPAEDDEDDDIDLFGSDNEEEDKEAAQLREERLRQYAEKAKKPALVAKSSILLDVKPWDDETDMAQLEACVRSIELDGLVWGTSKLMPVGYGIRKLQIQCVVEDDKVGTYLLEEEITKFEEHVQSVDIAAFNKI

SEQ ID NO: 944 - protein, 647 aa, Homo sapiens; identical to SEQ ID NO: 940

SEQ ID NO: 945 - protein, 225 aa, Homo sapiens; identical to SEQ ID NO: 936

SEQ ID NO: 946 - protein, 224 aa, Homo sapiens
GFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 947 - protein, 280 aa, Homo sapiens
ATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 948 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 949 - protein, 531 aa, Homo sapiens; identical to SEQ ID NO: 948

SEQ ID NO: 950 - protein, 531 aa, Homo sapiens; identical to SEQ ID NO: 948

SEQ ID NO: 951 - protein, 566 aa, Homo sapiens
MQWSSERGERLLTPGACSSEVPSAVPSRSGGTSAAMSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 952 - protein, 173 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKWSTILCSTC

SEQ ID NO: 953 - protein, 77 aa, Homo sapiens
MDGTRTSLDIEEYSDTEVQKNQVLTLEEWQDKWVNGKTAFHQEQGHQLLKKHLDTFLKGKSGLRVFFPLCGKAVEMK

SEQ ID NO: 954 - protein, 245 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 955 - protein, 245 aa, Homo sapiens; identical to SEQ ID NO: 954

SEQ ID NO: 956 - protein, 226 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDIQCFPSWERSFSISCVFFLMIQLNIQVHHFMFHMLKLKGCLVKYAIYVVLRRLMLLKNDIKVGELTVFLKSYIYLQKSK

SEQ ID NO: 957 - protein, 245 aa, Homo sapiens; identical to SEQ ID NO: 954

SEQ ID NO: 958 - protein, 90 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWYEQININRIILP

SEQ ID NO: 959 - protein, 1539 aa, Homo sapiens [sequence omitted]

SEQ ID NO: 960 - protein, 1539 aa, Homo sapiens [sequence omitted]

SEQ ID NO: 961 - protein, 1527 aa, Homo sapiens [sequence omitted]

SEQ ID NO: 962 - protein, 471 aa, Homo sapiens
MSHHPSGLRAGFSSTSYRRTFGPPPSLSPGAFSYSSSSRFSSSRLLGSASPSSSVRLGSFRSPRAGAGALLRLPSERLDFSMAEALNQEFLATRSNEKQELQELNDRFANFIEKVRFLEQQNAALRGELSQARGQEPARADQLCQQELRELRRELELLGRERDRVQVERDGLAEDLAALKQRLEEETRKREDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGAARLEEELRQLKEEMARHLREYQELLNVKMALDIEIATYRKLLEGEESRISVPVHSFASLNIKTTVPEVEPPQDSHSRKTVLIKTIETRNGEQVVTESQKEQRSELDKSSAHSY

SEQ ID NO: 963 - protein, 471 aa, Homo sapiens [sequence omitted]

SEQ ID NO: 964 - protein, 1873 aa, Homo sapiens [sequence omitted]

SEQ ID NO: 965 - protein, 1722 aa, Homo sapiens
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNNSLMWFDKTPLSYTHWRAGRPTIKNEKFLAGLSTDGFWDIQTFKVIEEAVYFHQHSILACKIEMVDYKEEHNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 966 - protein, 1722 aa, Homo sapiens [sequence omitted]

SEQ ID NO: 967 - protein, 1817 aa, Homo sapiens [sequence omitted]

SEQ ID NO: 968 - protein, 397 aa, Homo sapiens
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 969 - protein, 402 aa, Homo sapiens
MQCSSWYLHVGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 970 - protein, 344 aa, Homo sapiens
MGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGHCFLFQASRWKICRWISLHWRWPRYCCHHSEHSLKRPVSSL

SEQ ID NO: 971 - protein, 397 aa, Homo sapiens; identical to SEQ ID NO: 968

SEQ ID NO: 972 - protein, 342 aa, Homo sapiens
MGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 973 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 974 - protein, 257 aa, Homo sapiens; identical to SEQ ID NO: 973

SEQ ID NO: 975 - protein, 257 aa, Homo sapiens; identical to SEQ ID NO: 973

SEQ ID NO: 976 - protein, 257 aa, Homo sapiens; identical to SEQ ID NO: 973

SEQ ID NO: 977 - protein, 257 aa, Homo sapiens; identical to SEQ ID NO: 973

SEQ ID NO: 978 - protein, 1043 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 979 - protein, 1061 aa, Homo sapiens [sequence omitted]

SEQ ID NO: 980 - protein, 1078 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 981 - protein, 383 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKVLNFYEQNQL

SEQ ID NO: 982 - protein, 850 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKAKVPGSAVPEAGRDPEGKALCQ

SEQ ID NO: 983 - protein, 1136 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELRRLKEEARNKHAIAVIWAYWLGSKARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 984 - protein, 859 aa, Homo sapiens [sequence omitted]

SEQ ID NO: 985 - protein, 629 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRYFWHMKLSQFKCESTPKEYHFSLCFNLSVAQAEGN

SEQ ID NO: 986 - protein, 1078 aa, Homo sapiens; identical to SEQ ID NO: 980

SEQ ID NO: 987 - protein, 204 aa, Homo sapiens
MSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 988 - protein, 323 aa, Homo sapiens
MDSKQQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 989 - protein, 323 aa, Homo sapiens; identical to SEQ ID NO: 988

SEQ ID NO: 990 - protein, 300 aa, Homo sapiens
MQISQVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 991 - protein, 2421 aa, Homo sapiens [sequence omitted]

SEQ ID NO: 992 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 993 - protein, 2421 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 994 - protein, 2477 aa, Homo sapiens [sequence omitted]

SEQ ID NO: 995 - protein, 727 aa, Homo sapiens
MLRGPGPGLLLLAVLCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSMYTTTLMPPTPEVPRARLS

SEQ ID NO: 996 - protein, 2386 aa, Homo sapiens [sequence omitted]

SEQ ID NO: 997 - protein, 657 aa, Homo sapiens [sequence omitted]

SEQ ID NO: 998 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 999 - protein, 642 aa, Homo sapiens [sequence omitted]

SEQ ID NO: 1000 - protein, 984 aa, Homo sapiens [sequence omitted]

SEQ ID NO: 1001 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1002 - protein, 2355 aa, Homo sapiens [sequence omitted]

SEQ ID NO: 1003 - protein, 843 aa, Homo sapiens
MLRGPGPGLLLLAVLCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGQLK

SEQ ID NO: 1004 - protein, 2446 aa, Homo sapiens [sequence omitted]

SEQ ID NO: 1005 - protein, 2330 aa, Homo sapiens [sequence omitted]

SEQ ID NO: 1006 - protein, 843 aa, Homo sapiens; identical to SEQ ID NO: 1003

SEQ ID NO: 1007 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 1008 - protein, 984 aa, Homo sapiens [sequence omitted]

SEQ ID NO: 1009 - protein, 2296 aa, Homo sapiens [sequence omitted]

SEQ ID NO: 1010 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1011 - protein, 2386 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTQGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1012 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1013 - protein, 843 aa, Homo sapiens; identical to SEQ ID NO: 1003

SEQ ID NO: 1014 - protein, 727 aa, Homo sapiens; identical to SEQ ID NO: 995

SEQ ID NO: 1015 - protein, 2355 aa, Homo sapiens [sequence omitted]

SEQ ID NO: 1016 - protein, 2176 aa, Homo sapiens [sequence omitted]

SEQ ID NO: 1017 - protein, 781 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 1018 - protein, 781 aa, Homo sapiens; identical to SEQ ID NO: 1017

SEQ ID NO: 1019 - protein, 781 aa, Homo sapiens; identical to SEQ ID NO: 1017

SEQ ID NO: 1020 - protein, 781 aa, Homo sapiens; identical to SEQ ID NO: 1017

SEQ ID NO: 1021 - protein, 781 aa, Homo sapiens; identical to SEQ ID NO: 1017

SEQ ID NO: 1022 - protein, 1251 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKGTARAGWGQGCLEGMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 1023 - protein, 1241 aa, Homo sapiens
MSSAPRLPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 1024 - protein, 1241 aa, Homo sapiens
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 1025 - protein, 1241 aa, Homo sapiens; identical to SEQ ID NO: 1024

SEQ ID NO: 1026 - protein, 1158 aa, Homo sapiens
MSSAPRRPAKGADSFCTGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 1027 - protein, 861 aa, Homo sapiens [sequence omitted]

SEQ ID NO: 1028 - protein, 124 aa, Homo sapiens
MVDLTQVMDDEVFMAFASYATIILSKMMLMSTATAFYRLTRKVFANPEDCVAFGKGENAKKYLRTDDRVERVRRAQEILGPERQIQKNLHVNETGVEMRMAGNAWKQTCNCLMAWSSKSQSRLA

SEQ ID NO: 1029 - protein, 155 aa, Homo sapiens
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 1030 - protein, 101 aa, Homo sapiens
MVDLTQVMDDEVFMAFASYATIILSKMMLMSTATAFYRLTRKVFANPEDCVAFGKGENAKKYLRTDDRVERVRRRSFVLVVQDGVQWHDLSSPQPLPPGFK

SEQ ID NO: 1031 - protein, 155 aa, Homo sapiens; identical to SEQ ID NO: 1029

SEQ ID NO: 1032 - protein, 106 aa, Homo sapiens
MVDLTQVMDDEVFMAFASYATIILSKMMLMSTATAFYRLTRKVFANPEDCVAFGKGENAKKYLRTDDRVERVRSHCKAVTISIFERQSQNGATNEVKSMLYRVQQL

SEQ ID NO: 1033 - protein, 155 aa, Homo sapiens; identical to SEQ ID NO: 1029

SEQ ID NO: 1034 - protein, 87 aa, Homo sapiens
MVDLTQVMDDEVFMAFASYATIILSKMMLMSTATAFYRLTRKVFANPEDCVAFGKGENAKKYLRTDDRVERVRRIKQTLSIYLASSI

SEQ ID NO: 1035 - protein, 169 aa, Homo sapiens [sequence omitted]

SEQ ID NO: 1036 - protein, 155 aa, Homo sapiens; identical to SEQ ID NO: 1029

SEQ ID NO: 1037 - protein, 121 aa, Homo sapiens [sequence omitted]

SEQ ID NO: 1038 - protein, 111 aa, Homo sapiens
MFTSAGSEGTGQALASPGSCLEEFRASPFLECHGRGTCNYYSNSYSFWLASLNPERMFRKPIPSTVKDWGIRKNNKSLSGVHEEKTLKLKKTAELLFFILKNKVMTEHAVI

SEQ ID NO: 1039 - protein, 1381 aa, Homo sapiens [sequence omitted]

SEQ ID NO: 1040 - protein, 1677 aa, Homo sapiens [sequence omitted]

SEQ ID NO: 1041 - protein, 111 aa, Homo sapiens; identical to SEQ ID NO: 1038

SEQ ID NO: 1042 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKGEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTLGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 1043 - protein, 600 aa, Homo sapiens
MALRRALPALRPCIPRFVQLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHRAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 1044 - protein, 516 aa, Homo sapiens
MLEFVMREWKKSRKLLGQRLFNKLMKMTFYGHFVAGEDQESIQPLLRHYRAFGVSAILDYGVEEDLSPEEAEHKEMESCSSAAERDGSGTNKRDKQYQAHRAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 1045 - protein, 600 aa, Homo sapiens [sequence omitted]

SEQ ID NO: 1046 - protein, 577 aa, Homo sapiens
MHWLRKVQGLCTLWGTQMSSRTLYINSRQLVSLQWGHQEVPAKFNLASDVLDHWADMEKAGKRLPSPALWWVNGKGKELMWNFRELSENSQQAANVLSGACGLQRGDRVAVMLPRVPEWWLVILGCIRAGLIIMPETIQMKSADILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 1047 - protein, 577 aa, Homo sapiens
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 1048 - protein, 333 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYGT

SEQ ID NO: 1049 - protein, 425 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDTTATTEPAVHDSRAGEEGSIRAVDHAVIGGVVAVVVFAMLCLLIILGRYFARHKGTYFTHEAKGADDAADADTAIINAEGGQNNSEEKKEYFI

SEQ ID NO: 1050 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQRDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 1051 - protein, 414 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 1052 - protein, 443 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 1053 - protein, 1771 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEFLEGATIEVDQIHTHMRPLLMMLGDYRSLTLNVVNRLTSVTRLFPNSFNDKFCDQMMEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQVFGRSQSLPGADSLLAKPIDKQHTDTVVNFLIRVACQ

SEQ ID NO: 1054 - protein, 3830 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 1055 - protein, 3859 aa, Homo sapiens [sequence omitted]

SEQ ID NO: 1056 - protein, 3874 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKHGQPATGVPGSESRHRHHDPPAQPRPVRRRGKQGEHPGGRGKQPGQSVPHGPRLAPLAVTVAATATRNVKGAPGSEPAAFTTSPCLVPYIHRSPIVSLGCGYFPGSLRVRKGEYSFRGS

SEQ ID NO: 1057 - protein, 3921 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKHGQPATGVPGSESRHRHHDPPAQPRPVRRRGKQGEHPGGRGKQPGQSVPHGPRLAPLAVTVAATATRNVKGAPGSEPAAFTTSPCLVPYIHRSPIVSLGCGYFPGSLRVRKGEYSFRGS

SEQ ID NO: 1058 - protein, 737 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLDFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 1059 - protein, 740 aa, Homo sapiens [sequence omitted]

SEQ ID NO: 1060 - protein, 758 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 1061 - protein, 737 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 1062 - protein, 449 aa, Homo sapiens
DKYHEVFSLELKRERFKGTSQFENQNALSTPSTCWQHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1063 - protein, 1151 aa, Homo sapiens
FNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLKRMDIGPKQTQVGIVQYGENVTHEFNLNKYSSTEEVLVAAKKIVQRGGRQTMTALGTDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFEVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1064 - protein, 1177 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1065 - protein, 708 aa, Homo sapiens
MEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1066 - protein, 451 aa, Homo sapiens
DKYHEVFSLELKRERFKGTSQFENQNALSTPSTCWQDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1067 - protein, 1179 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1068 - protein, 286 aa, Homo sapiens
MAEDGEEAEFHFAALYISGQWPRLRADTDLQRLGSSAMAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 1069 - protein, 248 aa, Homo sapiens
APSRKFFVGGNWKMNGRKKNLGELITTLNAAKVPADTEVVCAPPTAYIDFARQKLDPKIAVAAQNCYKVTNGAFTGEISPGMIKDCGATWVVLGHSERRHVFGESDELIGQKVAHALSEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 1070 - protein, 74 aa, Homo sapiens
PREKIRDVFFQEGCLTKSVSQQLIGQKVAHALAEGLGVIACIGEKLDEREAGITEKVVFEQTKVIAGISGERDL

SEQ ID NO: 1071 - protein, 249 aa, Homo sapiens [sequence omitted]

SEQ ID NO: 1072 - protein, 286 aa, Homo sapiens; identical to SEQ ID NO: 1068

SEQ ID NO: 1073 - protein, 248 aa, Homo sapiens
APSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 1074 - protein, 410 aa, Homo sapiens [sequence omitted]

SEQ ID NO: 1075 - protein, 444 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 1076 - protein, 444 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 1077 - protein, 106 aa, Homo sapiens
MMAACDPRHGRYLTVAAVFHGRISMKEVDEQMLNVQNKNSSYFVEWIPNNVKTAVCDIPPRGLKMAVTFIGNSSAIQELFKRILEQFTAMFGRKAFLHWYTGEGMD

SEQ ID NO: 1078 - protein, 364 aa, Homo sapiens [sequence omitted]

SEQ ID NO: 1079 - protein, 287 aa, Homo sapiens
EGNRAHPGWSVWQPDRCLSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 1080 - protein, 444 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKMREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPAFAPLTSRGSQQYRGLTVPELTQQMFDAKNMMAACDPRHGRYLTVAAVFRGRMSMKEVDEQMLSVQSKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEQGEFEEEAEEEVA

SEQ ID NO: 1081 - protein, 445 aa, Homo sapiens
MREIVHLQAGQCGNQIGAKFWEVISDEHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 1082 - protein, 373 aa, Homo sapiens
MDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 1083 - protein, 355 aa, Homo sapiens
MKNSQCGARKNWAKGHYTEGTELMESVMYVVRKEAESCNCLQGFQLTHSLGWGTGSGMGTLLISKIREEYPDRIINTFSVLPSPKVSDTVVEPYNATLSVHQLIENVDETFCIDNEALYDICSRTLKLPTPTYGDLNHLVSATMSGVTTCLRFPGQLNADLRKLAVNMVPFPRLHFFMPGFAPLTSQGSQQYRALTVAELTQQMFDAKNMMAARDPRHGRYLTAAAIFQGRMPMREVDEQMFNIQNKNSSYFADWLPNNLKTAVCDIPPRELKMSVTFIGNNTAIQELFKRVSEQFTAMFRRKAFLHWYTGEGMEEMEFTEAESNMNDLVSEYQQYQDATAEEEEFEEYAEEEVA

SEQ ID NO: 1084 - protein, 444 aa, Homo sapiens; identical to SEQ ID NO: 1076

SEQ ID NO: 1085 - protein, 373 aa, Homo sapiens
MDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 1086 - protein, 548 aa, Homo sapiens [sequence omitted]

SEQ ID NO: 1087 - protein, 373 aa, Homo sapiens; identical to SEQ ID NO: 1082

SEQ ID NO: 1088 - protein, 445 aa, Homo sapiens
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYSIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 1089 - protein, 444 aa, Homo sapiens [sequence omitted]

SEQ ID NO: 1090 - protein, 444 aa, Homo sapiens; identical to SEQ ID NO: 1075

SEQ ID NO: 1091 - protein, 290 aa, Homo sapiens
MREIVHIQAGQCGNQIGAKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 1092 - protein, 212 aa, Homo sapiens [sequence omitted]

SEQ ID NO: 1093 - protein, 410 aa, Homo sapiens
MNMPSTPLAPTTGTATCSWSASTCTTTRPAVRPPSFPHRPPGNAALPSLMPSRPTQVAGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 1094 - protein, 445 aa, Homo sapiens [sequence omitted]

SEQ ID NO: 1095 - protein, 67 aa, Homo sapiens
MREIVHLQAGQCGNQIGAKHGIDPTGTYHGDSDLQLERINVYYNEATGEAPAPSPTALRGPRGPCLG

SEQ ID NO: 1096 - protein, 437 aa, Homo sapiens
MREIVHLQAGQCGNQIGAKHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 1097 - protein, 495 aa, Homo sapiens
MRRGAADRETERLPGAQGPCSAVSAASSTLAAAAAPRARATAAASTLSATAMREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 1098 - protein, 444 aa, Homo sapiens
MREIVLTQIGQCGNQIGAKFWEVISDEHAIDSAGTYHGDSHLQLERINVYYNEASGGRYVPRAVLVDLEPGTMDSVRSGPFGQVFRPDNFIFGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 1099 - protein, 354 aa, Homo sapiens
LTGQCGARKNWAKGHYTEGTELMESVMYVVRKEAESCNCLQGFQLTHSLGWGTGSGMGTLLISKIREEYPDRIINTFSVLPSPKVSDTVVEPYNATLSVHQLIENVDETFCIDNEALYDICSRTLKLPTPTYGDLNHLVSATMSGVTTCLRFPGQLNADLRKLAVNMVPFPRLHFFMPGFAPLTSQGSQQYRALTVAELTQQMFDAKNMMAARDPRHGRYLTAAAIFQGRMPMREVDEQMFNIQNKNSSYFADWLPNNLKTAVCDIPPRELKMSVTFIGNNTAIQELFKRVSEQFTAMFRRKAFLHWYTGEGMEEMEFTEAESNMNDLVSEYQQYQDATAEEEEFEEYAEEEVA

SEQ ID NO: 1100 - protein, 444 aa, Homo sapiens; identical to SEQ ID NO: 1076

SEQ ID NO: 1101 - protein, 444 aa, Homo sapiens; identical to SEQ ID NO: 1075

SEQ ID NO: 1102 - protein, 410 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 1103 - protein, 410 aa, Homo sapiens; identical to SEQ ID NO: 1102

SEQ ID NO: 1104 - protein, 410 aa, Homo sapiens; identical to SEQ ID NO: 1102

SEQ ID NO: 1105 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1106 - protein, 743 aa, Homo sapiens
EVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEGQLALLATQVEGQATNLQRLAEPSQLLKSAIVHLINYQDDAELVTRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMACAGRRAQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 1107 - protein, 745 aa, Homo sapiens; identical to SEQ ID NO: 1105

SEQ ID NO: 1108 - protein, 745 aa, Homo sapiens; identical to SEQ ID NO: 1105

SEQ ID NO: 1109 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 1110 - protein, 745 aa, Homo sapiens; identical to SEQ ID NO: 1105

SEQ ID NO: 1111 - protein, 241 aa, Homo sapiens
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 1112 - protein, 213 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 1113 - protein, 213 aa, Homo sapiens; identical to SEQ ID NO: 1112

SEQ ID NO: 1114 - protein, 258 aa, Homo sapiens
MSNVQNVDVESPRHWQLGLRCAAMLEESARSPGKGSTPLGLVPEGLICICSMRFCPFAERTHLVLKAEGIRHEVIYINLKDKPEWFFKKNPFSLVPVLENSQGQLIYESAITCEYLDEAYSGKKLLPDDPYDKACQKMVFELFSKVPSLVGSFLRTQNKEDGAGLKEALCKEFSKLEEVLINKKTTFFGGSSISMIDYVIWPSFERLEAMKLNECVEHTPELKLWMAAMREDPTVSALLTGVKDWQGFTELYLQPGGL

SEQ ID NO: 1115 - protein, 213 aa, Homo sapiens; identical to SEQ ID NO: 1112

SEQ ID NO: 1116 - protein, 241 aa, Homo sapiens; identical to SEQ ID NO: 1111

SEQ ID NO: 1117 - protein, 500 aa, Homo sapiens
SSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 1118 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 1119 - protein, 501 aa, Homo sapiens; identical to SEQ ID NO: 1118

SEQ ID NO: 1120 - protein, 501 aa, Homo sapiens; identical to SEQ ID NO: 1118

SEQ ID NO: 1121 - protein, 501 aa, Homo sapiens; identical to SEQ ID NO: 1118

SEQ ID NO: 1122 - protein, 2504 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRHEEQQVPILEKFCFTPHTEEGCLSEHAALEEELQLCKGLVEALETKVTQQGLKMVVPDWTGPRSPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPRDIVAFLTSTEPQYGQGILSQDAWESLFSRVSLRLVGLKKSFYGATLFLCRRPTPQDSPIFLPVDDTSFRWVESLKGILADEDSSRPVWLKAINCATSGVVGLVNCLRREPGGTVRCVLLSNLSSTSHVPEVDPGSAELQKVLQGDLVMNVYRDGAWGVFRHFLLEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCFGTHGRFLEIGKFDLSQNHPLGMAIFLKNVTFHGVLLDAFFNESSADWREVWALVEAAIRDGVVRPLKCTVFHGAQVEDAFRYMAQGKHIGKVVVQVLAEEPAVLKGAKPKLMSAISKTFCPAHKSYIIAGGLGGFGLELAQWLIQRGVQKLVLTSRSGIRTGYQAKQVRRWRRQGLQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGTVGILVETMSTNDTIVSGTLPTRIGVLGLEVLDLFLNQPHMVLSSFVLAEKAAAYRDRDSQRDLVEAVAHILGIRDLAAVNLGGSLADLGLDSLMSAPVRQTLERELNLVLSVREVRQLTLRKLQELSSKADEASELACPTPKEDGLAQQQTQLNLRSLLVKPEGPTLMRLNSVQSSERPLFLVHPIEATTVFHSLGPGLSIPTYGLQCTPAAPLDSIHSLAAYYIDCIRQVQPEGPYRVAGYSYGACVAFEMCSQLQAQQSPAPTHNSLFLFDGSPTYVLAYTQSYRAKLTPGCKAEAETEAICFFVQQFTDMEHNRVLEALLPLKGLEERVAAAVDLIIKSHQGLDRQELSFAARSFYYRLRAADQYTPKAKYSGNVMLLRAKTGGRYGEDLGADYNLSQVCDGKVSVHIIEGDHRTLLEGSGLESIISIIHSSLAEPRVSREG

SEQ ID NO: 1123 - protein, 2511 aa, Homo sapiens [sequence omitted]

SEQ ID NO: 1124 - protein, 2511 aa, Homo sapiens
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1125 - protein, 80 aa, Homo sapiens [sequence omitted]

SEQ ID NO: 1126 - protein, 963 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 1127 - protein, 963 aa, Homo sapiens; identical to SEQ ID NO: 1126

SEQ ID NO: 1128 - protein, 575 aa, Homo sapiens
MERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 1129 - protein, 737 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 1130 - protein, 737 aa, Homo sapiens; identical to SEQ ID NO: 1129

SEQ ID NO: 1131 - protein, 673 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 1132 - protein, 274 aa, Homo sapiens
MGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 1133 - protein, 274 aa, Homo sapiens; identical to SEQ ID NO: 1132

SEQ ID NO: 1134 - protein, 254 aa, Homo sapiens
MGTDSRAAKALLARARTLHLQTGNLLNWGRLRKKCPSTHSEELHDCIQKTLNEWSSQINPDLVREFPDVLECTVSHAVEKINPDEREEMKVSACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 1135 - protein, 274 aa, Homo sapiens; identical to SEQ ID NO: 1132

SEQ ID NO: 1136 - protein, 254 aa, Homo sapiens; identical to SEQ ID NO: 1134

SEQ ID NO: 1137 - protein, 171 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCARKSVGKVISWFAQNLSGFSTQSLTSGISSVTAQ

SEQ ID NO: 1138 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 1139 - protein, 345 aa, Homo sapiens; identical to SEQ ID NO: 1138

SEQ ID NO: 1140 - protein, 681 aa, Homo sapiens [sequence omitted]

SEQ ID NO: 1141 - protein, 698 aa, Homo sapiens
CGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 1142 - protein, 642 aa, Homo sapiens [sequence omitted]

SEQ ID NO: 1143 - protein, 302 aa, Homo sapiens [sequence omitted]

SEQ ID NO: 1144 - protein, 202 aa, Homo sapiens
MLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 1145 - protein, 847 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 1146 - protein, 850 aa, Homo sapiens [sequence omitted]

SEQ ID NO: 1147 - protein, 521 aa, Homo sapiens
MPSRIRQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 1148 - protein, 847 aa, Homo sapiens; identical to SEQ ID NO: 1145

SEQ ID NO: 1149 - protein, 1179 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 1150 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 1151 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 1152 - protein, 141 aa, Homo sapiens
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKRF

SEQ ID NO: 1153 - protein, 245 aa, Homo sapiens
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 1154 - protein, 245 aa, Homo sapiens; identical to SEQ ID NO: 1153

SEQ ID NO: 1155 - protein, 245 aa, Homo sapiens; identical to SEQ ID NO: 1153

SEQ ID NO: 1156 - protein, 468 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 1157 - protein, 464 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 1158 - protein, 258 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGKLLIEHFLQLARRSLCRKKSILQTYIWPTCKH

SEQ ID NO: 1159 - protein, 562 aa, Homo sapiens
MVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 1160 - protein, 580 aa, Homo sapiens
MSDFEEWISGTYRKMEEGPLPLLTFATAPYHDQKPGTSGLRKKTYYFEEKPCYLENFIQSIFFSIDLKDRQGSSLVVGGDGRYFNKSAIETIVQMAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 1161 - protein, 562 aa, Homo sapiens; identical to SEQ ID NO: 1159

SEQ ID NO: 1162 - protein, 561 aa, Homo sapiens
VKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 1163 - protein, 334 aa, Homo sapiens
MIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 1164 - protein, 267 aa, Homo sapiens
MISLGKVNCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 1165 - protein, 334 aa, Homo sapiens; identical to SEQ ID NO: 1163

SEQ ID NO: 1166 - protein, 300 aa, Homo sapiens
KLFFKAGTVLPAFQTTVKVDSPSLDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 1167 - protein, 334 aa, Homo sapiens; identical to SEQ ID NO: 1163

SEQ ID NO: 1168 - protein, 320 aa, Homo sapiens
PWRPPGSSLGGTGRTDGRRAWGSSSALRRPRCRPTLRWFALSPLPISTLPQKLEPKIAVAAQNCYKVTNGAFTWEISPGMIKDCKANRGSWGTQRVGMSLGSQISLGRKWPMLWQRDSESLALGRSLKGKWHHEVCFREERGHRRREGLEQGRPGLRACVGHWYQQDCNTPEGPGSTREVLRMVSNISDVVAQSTRIHLWRLCDGGNLQGAGQPASGWLPRGCFPQALIRGHHQCQTMSPIHLPYPSCQARDAAQKPSNCPSPAHVSDGVICPLLRPHPNCTFLYCLYLHPVMVGTRPLPSPLSIIVGTRRHQGGFSLAE

SEQ ID NO: 1169 - protein, 92 aa, Homo sapiens
RLSLVSSPCGTILSSEVVCAPPTAYIDFARQKLDPKIAVAAQNCYKVTNGAFTGEISPGMIKDCGATWVVLGHSERRHVFGESDEVSSQERR

SEQ ID NO: 1170 - protein, 529 aa, Homo sapiens
MSCRQFSSSYLSRSGGGGGGGLGSGGSIRSSYSRFSSSGGGGGGGRFSSSSGYGGGSSRVCGRGGGGSFGYSYGGGSGGGFSASSLGGGFGGGSRGFGGASGGGYSSSGGFGGGFGGGSGGGFGGGYGSGFGGFGGFGGGAGGGDGGILTANEKSTMQELNSRLASYLDKVQALEEANNDLENKIQDWYDKKGPAAIQKNYSPYYNTIDDLKDQIVDLTVGNNKTLLDIDNTRMTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGIQGRKWRQLWWRRKWRWLWWRKWVQGRKWRQLRWRKWFWRR

SEQ ID NO: 1171 - protein, 622 aa, Homo sapiens
MSCRQFSSSYLTSGGGGGGGLGSGGSIRSSYSRFSSSGGRGGGGRFSSSSGYGGGSSRVCGRGGGGSFGYSYGGGSGGGFSASSLGGGFGGGSRGFGGASGGGYSSSGGFGGGFGGGSGGGFGGGYGSGFGGLGGFGGGAGGGDGGILTANEKSTMQELNSRLASYLDKVQALEEANNDLENKIQDWYDKKGPAAIQKNYSPYYNTIDDLKDQIVDLTVGNNKTLLDIDNTRMTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGSRGGSGGSYGGGGSGGGYGGGSGSRGGSGGSYGGGSGSGGGSGGGYGGGSGGGHSGGSGGGHSGGSGGNYGGGSGSGGGSGGGYGGGSGSRGGSGGSHGGGSGFGGESGGSYGGGEEASGSGGGYGGGSGKSSHS

SEQ ID NO: 1172 - protein, 548 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 1173 - protein, 192 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 1174 - protein, 192 aa, Homo sapiens; identical to SEQ ID NO: 1173

SEQ ID NO: 1175 - protein, 192 aa, Homo sapiens; identical to SEQ ID NO: 1173

SEQ ID NO: 1176 - protein, 185 aa, Homo sapiens
MQAIKAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 1177 - protein, 462 aa, Homo sapiens [sequence omitted]

SEQ ID NO: 1178 - protein, 463 aa, Homo sapiens [sequence omitted]

SEQ ID NO: 1179 - protein, 465 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDVFQQVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 1180 - protein, 460 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 1181 - protein, 917 aa, Homo sapiens
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGIELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKIRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIRTRYDTEVDEGSLNPGKQRYEKMTSGMYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEK

SEQ ID NO: 1182 - protein, 917 aa, Homo sapiens
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIRTRYDTEVDEGSLNPGKQRYEKMTSGMYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEN

SEQ ID NO: 1183 - protein, 715 aa, Homo sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 1184 - protein, 715 aa, Homo sapiens; identical to SEQ ID NO: 1183

SEQ ID NO: 1185 - protein, 659 aa, Homo sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGDQVFQGANGGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDR

SEQ ID NO: 1186 - protein, 268 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEGERGGIRSPGTAGC

SEQ ID NO: 1187 - protein, 377 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 1188 - protein, 380 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEGERDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 1189 - protein, 268 aa, Homo sapiens; identical to SEQ ID NO: 1186

SEQ ID NO: 1190 - protein, 377 aa, Homo sapiens; identical to SEQ ID NO: 1187

SEQ ID NO: 1191 - protein, 268 aa, Homo sapiens; identical to SEQ ID NO: 1186

SEQ ID NO: 1192 - protein, 1104 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 1193 - protein, 1104 aa, Homo sapiens; identical to SEQ ID NO: 1192

SEQ ID NO: 1194 - protein, 1114 aa, Homo sapiens
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPMVTSELYPPQLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 1195 - protein, 1114 aa, Homo sapiens; identical to SEQ ID NO: 1194

SEQ ID NO: 1196 - protein, 194 aa, Homo sapiens [sequence omitted]

SEQ ID NO: 1197 - protein, 1091 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVSLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFRFSVGQHNYERGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 1198 - protein, 1091 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 1199 - protein, 1091 aa, Homo sapiens; identical to SEQ ID NO: 1198

SEQ ID NO: 1200 - protein, 437 aa, Homo sapiens [sequence omitted]

SEQ ID NO: 1201 - protein, 133 aa, Homo sapiens
LRKRKCARPPKDRVSTFHLPNHLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 1202 - protein, 146 aa, Homo sapiens
MSYYFDRDDVALKNFAKYFLHQSHEEREHAEKLMKLQNQGGGRIFLQDIKKPDCDDWESGLNAMECALHLEKNVNQSLLELHKLATDKNDPHLCDFIETHYLNEQVKAIKELGDHMTNLCKMGAPESSLAEYLFDQHTLGDSDNES

SEQ ID NO: 1203 - protein, 183 aa, Homo sapiens [sequence omitted]

SEQ ID NO: 1204 - protein, 113 aa, Homo sapiens
MKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 1205 - protein, 183 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 1206 - protein, 130 aa, Homo sapiens
MTTASTSQVRQEHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 1207 - protein, 98 aa, Homo sapiens
NCRTNKVAEFSFRISRNQTDDWDSGLNVIECALHLEKNVNQSLLELHKLATDKNDPHLCDFIETHYLNEQVKAIKELGERDQLAQDGSTRIWLGRISL

SEQ ID NO: 1208 - protein, 87 aa, Homo sapiens [sequence omitted]

SEQ ID NO: 1209 - protein, 86 aa, Homo sapiens
MRWSVHYIWGKKNMSQSLLELHKLASDKNDPHLCDFIETHYLNEQVKAIKELGGHVTNLCKMGAPESGSAEYLFDKHTLGDSDNES

SEQ ID NO: 1210 - protein, 183 aa, Homo sapiens; identical to SEQ ID NO: 1205

SEQ ID NO: 1211 - protein, 145 aa, Homo sapiens
MTASNSQVRQNYHQDSEAAINRQINLELYASYFNLSMSYYFDRDDAALKNFAKYFLHQSHEEREHAEKLMKLQNQQECALHLEKNVNQSLLELHKLATDKNDPHLCDFIETHYLNEQVKAIKELGERDQLAQDGSTRIWLGRISL

SEQ ID NO: 1212 - protein, 103 aa, Homo sapiens
IFLQDIKKPDCDDWESRLNATECALHLEKNVNQSLLELHKLATDKNDPHLCDFIETHYLNEQVKAIKELGDQVTNLRKMGAPESGLAEYLFDKHILGDSDNES

SEQ ID NO: 1213 - protein, 113 aa, Homo sapiens
MKLQNQRGGRIFLQDIKKPDCDDWESGLNAMECALYLEKNVNQSLLELYKLATDKNDPHLCDFIETHYLNEQVKAIKELSDHVTNLRKMGAPESGSAEYLFDKHTLGDSDNES

SEQ ID NO: 1214 - protein, 183 aa, Homo sapiens; identical to SEQ ID NO: 1205

SEQ ID NO: 1215 - protein, 183 aa, Homo sapiens; identical to SEQ ID NO: 1205

SEQ ID NO: 1216 - protein, 153 aa, Homo sapiens
MTTASTSQSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 1217 - protein, 169 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDFPGHQGSACMLGFPLPFL

SEQ ID NO: 1218 - protein, 183 aa, Homo sapiens; identical to SEQ ID NO: 1205

SEQ ID NO: 1219 - protein, 182 aa, Homo sapiens
TTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 1220 - protein, 183 aa, Homo sapiens; identical to SEQ ID NO: 1205

SEQ ID NO: 1221 - protein, 190 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTWETVIMKAKPRANFP

SEQ ID NO: 1222 - protein, 98 aa, Homo sapiens [sequence omitted]

SEQ ID NO: 1223 - protein, 1012 aa, Homo sapiens
MRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 1224 - protein, 1012 aa, Homo sapiens; identical to SEQ ID NO: 1223

SEQ ID NO: 1225 - protein, 1393 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1226 - protein, 1118 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGLTSHGLRAHLQDLYHLELLLGQIA

SEQ ID NO: 1227 - protein, 1461 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1228 - protein, 1344 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1229 - protein, 1337 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1230 - protein, 1395 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1231 - protein, 1403 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1232 - protein, 1459 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1233 - protein, 1446 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1234 - protein, 1403 aa, Homo sapiens; identical to SEQ ID NO: 1231

SEQ ID NO: 1235 - protein, 1400 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1236 - protein, 1350 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1237 - protein, 1177 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGLTSHGLRAHLQDLYHLELLLGQIA

SEQ ID NO: 1238 - protein, 1431 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1239 - protein, 1365 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1240 - protein, 1416 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1241 - protein, 1352 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1242 - protein, 1408 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1243 - protein, 1474 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1244 - protein, 1380 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1245 - protein, 1418 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1246 - protein, 1123 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQDIH

SEQ ID NO: 1247 - protein, 1459 aa, Homo sapiens; identical to SEQ ID NO: 1232

SEQ ID NO: 1248 - protein, 614 aa, Homo sapiens
MSPHCSTTYLRTLGRTTMFWKTTEGRDGKMAVQEFSEFGLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSTPCPATPAGPKGRVFVDPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 1249 - protein, 647 aa, Homo sapiens [sequence omitted]

SEQ ID NO: 1250 - protein, 647 aa, Homo sapiens [sequence omitted]

SEQ ID NO: 1251 - protein, 875 aa, Homo sapiens [sequence omitted]

SEQ ID NO: 1252 - protein, 841 aa, Homo sapiens
MSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 1253 - protein, 875 aa, Homo sapiens
MESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQKKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 1254 - protein, 389 aa, Homo sapiens
MKQMNILFPNVETQCGTASARFSRDCKQLMTQSVDSNRGNRNEKRCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 1255 - protein, 389 aa, Homo sapiens; identical to SEQ ID NO: 1254

SEQ ID NO: 1256 - protein, 432 aa, Homo sapiens
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 1257 - protein, 432 aa, Homo sapiens; identical to SEQ ID NO: 1256

SEQ ID NO: 1258 - protein, 324 aa, Homo sapiens
MEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 1259 - protein, 324 aa, Homo sapiens; identical to SEQ ID NO: 1258

SEQ ID NO: 1260 - protein, 275 aa, Homo sapiens
MKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 1261 - protein, 403 aa, Homo sapiens
MCRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKVQWLTPVNLALWEAEAGGSLEGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 1262 - protein, 325 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 1263 - protein, 382 aa, Homo sapiens
MCRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 1264 - protein, 167 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKENWEKT

SEQ ID NO: 1265 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 1266 - protein, 628 aa, Homo sapiens
MPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 1267 - protein, 1101 aa, Homo sapiens [sequence omitted]

SEQ ID NO: 1268 - protein, 1091 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 1269 - protein, 1091 aa, Homo sapiens; identical to SEQ ID NO: 1268

SEQ ID NO: 1270 - protein, 1101 aa, Homo sapiens; identical to SEQ ID NO: 1265

SEQ ID NO: 1271 - protein, 1091 aa, Homo sapiens; identical to SEQ ID NO: 1268

SEQ ID NO: 1272 - protein, 1209 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 1273 - protein, 1224 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 1274 - protein, 1224 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKVSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 1275 - protein, 1233 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHEHSCPLPLTAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKLSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 1276 - protein, 447 aa, Homo sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 1277 - protein, 480 aa, Homo sapiens
MLTSHPRVLSGQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLLLPIETTLVYLGLSLLAGCDSSLTSGQGAFLPPRPSGWNLSPPGTEENGREERRERENVIFGLVAAHPHTQRSL

SEQ ID NO: 1278 - protein, 282 aa, Homo sapiens
MTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 1279 - protein, 447 aa, Homo sapiens; identical to SEQ ID NO: 1276

SEQ ID NO: 1280 - protein, 414 aa, Homo sapiens
MLTSHPRVLSGQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 1281 - protein, 352 aa, Homo sapiens
MDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 1282 - protein, 2342 aa, Homo sapiens
MITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 1283 - protein, 2803 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 1284 - protein, 2342 aa, Homo sapiens; identical to SEQ ID NO: 1282

SEQ ID NO: 1285 - protein, 2468 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 1286 - protein, 2984 aa, Homo sapiens [sequence omitted]

SEQ ID NO: 1287 - protein, 2760 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVSDSDPYS

SEQ ID NO: 1288 - protein, 3027 aa, Homo sapiens
METTPGLGLRSPGAPLAQNPAELLCEAGAAVAAARWDLQKHSLLIVIGDIGTESQLRAVRAHLEQGILSWNIDLSSFDLNQQLRLFITRHLAHFSSEVKGQRTLCHQSEILETIILVNPSADSISSEVHHLLSSSSAYKLLILSGQSLEPGGDLILQSGTYSYENFAQVLHNPEISQLLSNRDPGIQAFLTVSCLGEGDWSHLGLSSSQETLHLRLNPEPTLPTMDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 1289 - protein, 2803 aa, Homo sapiens; identical to SEQ ID NO: 1283

SEQ ID NO: 1290 - protein, 2805 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKVEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVKVTLIPTHDTEVTREWYQQTHEQQQQLNVLVLASSSTVVMQDESFPACKIEF

SEQ ID NO: 1291 - protein, 2805 aa, Homo sapiens
  VARIANT (1)...(2805): Xaa = Any Amino Acid
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVXGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTPEYDSVVAAVQEGAAELEGGPYSPLGKDYRKVXGEREEEGRAEAPDKSSHXSKVPEARKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRXEPGPSMEPSLTPPAVPPRAPILSKGPSPPLNGNILSCSPDRRSPSPKESGRSHWDDSTSDSELEKGAREQAEKEAQSPSPPHPIPMGSPTLWPETEAHVSPPLXSHLGXARPSLDFPASAFGFSSLEXAPPQXPSPAEPRSAPCGSLAFSGDRALALAPGPPTRTRYDEYLEVTKAPSLDSSLPQLPSPSSPGXPLLSNLPRPASPALSEGSSSEATTPVISSVAERFSPSLEAAEQESGELDPGMEPAAHXLWDLTPLSPAPPASLDLALAPAPSLPGDMGDGILPCHLECSEAATEKPSPFQVPSEDCAANGPTETSPNPPXPAPAKAENEEAAAXPAWERGAWPEGAERSSRPDTXLSPEQPVCPXGGSGGPPSSASPEVEAGPQGCXTEPRPHRGELSPSFLNPPLPPSIDDRDLSTEEVRLVGRGGRRRVGGPGTTGXPXPVTDETPPTSASDSGSSQSDSDVPPETEECPSITAEAALDSDEDGDFLPVDKXGGVSGTHHPRPGHDPPPLPQPDXRPSPPRPDVCMADPEGLSSESGRXERLRXKEKVQGRVGRRAPGKDKPVSPXRRLXLRGKRSPTPGKGSXDRVSRXPXRSRSXTSQVTPAEEKDGHSPMSKGLVNGLKAGPXALSSKGSSGAPVYVDLAYIPNHWSGKTADLDFFRRVRASYYVVSGNDPANGEPSRAVLDALLEGKAQWGENLQVKVTLIPTHDTEVTREWYQQTHEQQQQLNVLVLASSSTVVMQDESFPACKIEF

SEQ ID NO: 1292 - protein, 2468 aa, Homo sapiens; identical to SEQ ID NO: 1285

SEQ ID NO: 1293 - protein, 2468 aa, Homo sapiens; identical to SEQ ID NO: 1285

SEQ ID NO: 1294 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1295 - protein, 810 aa, Homo sapiens; identical to SEQ ID NO: 1294

SEQ ID NO: 1296 - protein, 599 aa, Homo sapiens [sequence omitted]

SEQ ID NO: 1297 - protein, 589 aa, Homo sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 1298 - protein, 589 aa, Homo sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFEHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 1299 - protein, 136 aa, Homo sapiens
MHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 1300 - protein, 288 aa, Homo sapiens [sequence omitted]

SEQ ID NO: 1301 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 1302 - protein, 258 aa, Homo sapiens
PQVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVR

SEQ ID NO: 1303 - protein, 323 aa, Homo sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 1304 - protein, 259 aa, Homo sapiens [sequence omitted]

SEQ ID NO: 1305 - protein, 567 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCGRLPSFW

SEQ ID NO: 1306 - protein, 895 aa, Homo sapiens
MRMSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 1307 - protein, 895 aa, Homo sapiens; identical to SEQ ID NO: 1306

SEQ ID NO: 1308 - protein, 895 aa, Homo sapiens
MRMSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSDLQSVRTASPDPGEVVSSACAADEPVTVLTVILDADLTKMTPKQRIDLLHRMRSFSEVELHNMKLVPVVNNRLFDMSAFMAGPGNPKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTVPMEGKGSRPKNMTPYRSPPPYVPP

SEQ ID NO: 1309 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 1310 - protein, 1960 aa, Homo sapiens; identical to SEQ ID NO: 1309

SEQ ID NO: 1311 - protein, 1960 aa, Homo sapiens; identical to SEQ ID NO: 1309

SEQ ID NO: 1312 - protein, 502 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 1313 - protein, 502 aa, Homo sapiens; identical to SEQ ID NO: 1312

SEQ ID NO: 1314 - protein, 402 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKNISPD

SEQ ID NO: 1315 - protein, 312 aa, Homo sapiens
MIFSCPSSDTHSHIICWIFILWNQNTVMLTFFFPGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKNISPD

SEQ ID NO: 1316 - protein, 399 aa, Homo sapiens
MDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 1317 - protein, 363 aa, Homo sapiens [sequence omitted]

SEQ ID NO: 1318 - protein, 475 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 1319 - protein, 363 aa, Homo sapiens [sequence omitted]

SEQ ID NO: 1320 - protein, 475 aa, Homo sapiens; identical to SEQ ID NO: 1318

SEQ ID NO: 1321 - protein, 475 aa, Homo sapiens; identical to SEQ ID NO: 1318

SEQ ID NO: 1322 - protein, 363 aa, Homo sapiens [sequence omitted]

SEQ ID NO: 1323 - protein, 279 aa, Homo sapiens [sequence omitted]

SEQ ID NO: 1324 - protein, 400 aa, Homo sapiens [sequence omitted]

SEQ ID NO: 1325 - protein, 391 aa, Homo sapiens
MAALTTLFKYIDENQDRYIKKLAKWVAIQSVSAWPEKRGEIRRMMEVAAADVKQLGGSVELVDIGKQKEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 1326 - protein, 288 aa, Homo sapiens [sequence omitted]

SEQ ID NO: 1327 - protein, 288 aa, Homo sapiens [sequence omitted]

SEQ ID NO: 1328 - protein, 287 aa, Homo sapiens
AEKRHTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 1329 - protein, 795 aa, Homo sapiens [sequence omitted]

SEQ ID NO: 1330 - protein, 795 aa, Homo sapiens [sequence omitted]

SEQ ID NO: 1331 - protein, 795 aa, Homo sapiens [sequence omitted]

SEQ ID NO: 1332 - protein, 793 aa, Homo sapiens
MLSQVYRCGFQPFNQHLLPWVKCTTVFRSHCIQPSVIRHVRSWSNIPFITVPLSRTHGKSFAHRSELKHAKRIVVKLGSAVVTRGDECGLALGRLASIVEQVSVLQNQGREMMLVTSGAVAFGKQRLRHEILLSQSVRQALHSGQNQLKEMAIPVLEARACAAAGQSGLMALYEAMFTQYSICAAQILVTNLDFHDEQKRRNLNGTLHELLRMNIVPIVNTNDAVVPPAEPNSDLQGVISVKDNDSLAARLAVEMKTDLLIVLSDVEGLFDSPPGSDDAKLIDIFYPGDQQSVTFGTKSRVGMGGMEAKVKAALWALQGGTSVVIANGTHPKVSGHVITDIVEGKKVGTFFSEVKPAGPTVEQQGEMARSGGRMLATLEPEQRAEIIHHLADLLTDQRDEILLANKKDLEEAEGRLAAPLLKRLSLSTSKLNSLAIGLRQIAASSQDSVGRVLRRTRIAKNLELEQVTVPIGVLLVIFESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 1333 - protein, 795 aa, Homo sapiens [sequence omitted]

SEQ ID NO: 1334 - protein, 115 aa, Homo sapiens [sequence omitted]

SEQ ID NO: 1335 - protein, 86 aa, Homo sapiens
MKSGKYVLGYKQTLKMIRQGKAKLVILANNCPALRKSEIEYYAMLAKTGVHHYSGNNIELGTACGKYYRVCTLAIIDPGDSDIIRS

SEQ ID NO: 1336 - protein, 114 aa, Homo sapiens
VAAKKTKKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTGEK

SEQ ID NO: 1337 - protein, 115 aa, Homo sapiens [sequence omitted]

SEQ ID NO: 1338 - protein, 115 aa, Homo sapiens [sequence omitted]

SEQ ID NO: 1339 - protein, 262 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEVGNKCQVDVK

SEQ ID NO: 1340 - protein, 255 aa, Homo sapiens [sequence omitted]

SEQ ID NO: 1341 - protein, 546 aa, Homo sapiens [sequence omitted]

SEQ ID NO: 1342 - protein, 459 aa, Homo sapiens [sequence omitted]

SEQ ID NO: 1343 - protein, 357 aa, Homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 1344 - protein, 357 aa, Homo sapiens; identical to SEQ ID NO: 1343

SEQ ID NO: 1345 - protein, 1887 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGIRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPRLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 1346 - protein, 1887 aa, Homo sapiens [sequence omitted]

SEQ ID NO: 1347 - protein, 966 aa, Homo sapiens [sequence omitted]

SEQ ID NO: 1348 - protein, 508 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRVRETPHLCVHSFGVFMGLWLFVHSITFSITL

SEQ ID NO: 1349 - protein, 1886 aa, Homo sapiens [sequence omitted]

SEQ ID NO: 1350 - protein, 967 aa, Homo sapiens [sequence omitted]

SEQ ID NO: 1351 - protein, 146 aa, Homo sapiens
VHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 1352 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 1353 - protein, 137 aa, Homo sapiens
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 1354 - protein, 137 aa, Homo sapiens; identical to SEQ ID NO: 1353

SEQ ID NO: 1355 - protein, 137 aa, Homo sapiens; identical to SEQ ID NO: 1353

SEQ ID NO: 1356 - protein, 186 aa, Homo sapiens
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGESAAILLLGCS

SEQ ID NO: 1357 - protein, 127 aa, Homo sapiens
MNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVG

SEQ ID NO: 1358 - protein, 126 aa, Homo sapiens
TREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLQR

SEQ ID NO: 1359 - protein, 328 aa, Homo sapiens [sequence omitted]

SEQ ID NO: 1360 - protein, 127 aa, Homo sapiens
TREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLQRL

SEQ ID NO: 1361 - protein, 328 aa, Homo sapiens
MAAGIVASRRLRDLLTRRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLERLPKVIGNQSLVNELAFTAHKMMADEALDSGLVSRVFPDKEVMLDAALPLAPEISSKTTVLVQSTKVNLLYSRDHSVAESLNYVASWNMSMLQTQDLVKSVQPTTENKELKTVTFSKL

SEQ ID NO: 1362 - protein, 70 aa, Homo sapiens
GPDNCIQCAHYIDGPHCVKTCPAGVMGENNTLVWKYADAGHVCHLCHPNCTYGSYIVSHFPRSFYKMSVH

SEQ ID NO: 1363 - protein, 349 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTGELHAGMWVMSPGRGHEEHWSRNQDIPALVLPPATNTLNALCGLEPVTTLSGPLSNSHPSSGC

SEQ ID NO: 1364 - protein, 332 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 1365 - protein, 332 aa, Homo sapiens; identical to SEQ ID NO: 1364

SEQ ID NO: 1366 - protein, 331 aa, Homo sapiens
ATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 1367 - protein, 274 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKECRYTLGDPKGAAILKSSDVISFHCLGYNRILGGGCACCPFYLICD

SEQ ID NO: 1368 - protein, 291 aa, Homo sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 1369 - protein, 253 aa, Homo sapiens
MQRARPTLWAAALTLLVLLRGPPVARPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 1370 - protein, 291 aa, Homo sapiens
MQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 1371 - protein, 291 aa, Homo sapiens; identical to SEQ ID NO: 1368

SEQ ID NO: 1372 - protein, 301 aa, Homo sapiens
PLPAWIPQLRAVYCRPIPARPACQAACPGCRRHAAGATHALGRCADSAGAAPRAAGGAGWRELGGLGSRGALRAPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 1373 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1374 - protein, 892 aa, Homo sapiens; identical to SEQ ID NO: 1373

SEQ ID NO: 1375 - protein, 892 aa, Homo sapiens [sequence omitted]

SEQ ID NO: 1376 - protein, 887 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 1377 - protein, 892 aa, Homo sapiens; identical to SEQ ID NO: 1373

SEQ ID NO: 1378 - protein, 391 aa, Homo sapiens
DSPLEQSGHEVGILKETEAEDRIIKEEEARLSGRDMQVTSQPVIAELPPKVSVFVPPRDGFFGNPRKSKLICQATGFSPRQIEVSWLREGKQVGSGVTTDEVEAEAKESGPTTYKVTSTLTIKESDWLGQSMFTCRVDHRGLTFQQNASSMCGPDQDTAIRVFAIPPSFASIFLTKSTKLTCLVTDLTTYDSVTISWTRQDGEAVKTHTNISESHPNATFSAVGEASICEDDWDSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 1379 - protein, 454 aa, Homo sapiens
GSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRSKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 1380 - protein, 473 aa, Homo sapiens [sequence omitted]

SEQ ID NO: 1381 - protein, 652 aa, Homo sapiens
MRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGKGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 1382 - protein, 650 aa, Homo sapiens
MRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 1383 - protein, 547 aa, Homo sapiens
MDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 1384 - protein, 407 aa, Homo sapiens
MRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLGLYR

SEQ ID NO: 1385 - protein, 614 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 1386 - protein, 334 aa, Homo sapiens
MRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKYERYFTLI

SEQ ID NO: 1387 - protein, 614 aa, Homo sapiens; identical to SEQ ID NO: 1385

SEQ ID NO: 1388 - protein, 729 aa, Homo sapiens
MPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 1389 - protein, 650 aa, Homo sapiens; identical to SEQ ID NO: 1382

SEQ ID NO: 1390 - protein, 614 aa, Homo sapiens; identical to SEQ ID NO: 1385

SEQ ID NO: 1391 - protein, 418 aa, Homo sapiens
MRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLGSPALGNQMGLQRSI

SEQ ID NO: 1392 - protein, 761 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTLQAMPAAGGVLYQPSGPASFPSTFSPAGSVEGSPMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 1393 - protein, 777 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 1394 - protein, 710 aa, Homo sapiens
MESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 1395 - protein, 710 aa, Homo sapiens; identical to SEQ ID NO: 1394

SEQ ID NO: 1396 - protein, 690 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 1397 - protein, 350 aa, Homo sapiens
MAMRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 1398 - protein, 350 aa, Homo sapiens
MAMRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSECIFPSAPDVKA

SEQ ID NO: 1399 - protein, 350 aa, Homo sapiens; identical to SEQ ID NO: 1397

SEQ ID NO: 1400 - protein, 471 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 1401 - protein, 471 aa, Homo sapiens; identical to SEQ ID NO: 1400

SEQ ID NO: 1402 - protein, 470 aa, Homo sapiens
QSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 1403 - protein, 471 aa, Homo sapiens; identical to SEQ ID NO: 1400

SEQ ID NO: 1404 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 1405 - protein, 824 aa, Homo sapiens; identical to SEQ ID NO: 1404

SEQ ID NO: 1406 - protein, 807 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 1407 - protein, 307 aa, Homo sapiens
MTKAGSKGGNLRDKLDGNELDLSLSDLNEVPVKELAALPKATILDLSCNKLTTLPSDFCGLTHLVKLDLSKNKLQQLPADFGRLVNLQHLDLLNNKLVTLPVSFAQLKNLKWLDLKDNPLDPVLAKVAGDCLDEKQCKQCANKVLQHMKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 1408 - protein, 307 aa, Homo sapiens; identical to SEQ ID NO: 1407

SEQ ID NO: 1409 - protein, 160 aa, Homo sapiens
MKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 1410 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 1411 - protein, 128 aa, Homo sapiens; identical to SEQ ID NO: 1410

SEQ ID NO: 1412 - protein, 155 aa, Homo sapiens
MRGLSAEAARGWKRILGAARFCGQSQWESKEGLSCSGCCSSWLSSAIQVSHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 1413 - protein, 474 aa, Homo sapiens
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 1414 - protein, 474 aa, Homo sapiens; identical to SEQ ID NO: 1413

SEQ ID NO: 1415 - protein, 474 aa, Homo sapiens; identical to SEQ ID NO: 1413

SEQ ID NO: 1416 - protein, 474 aa, Homo sapiens; identical to SEQ ID NO: 1413

SEQ ID NO: 1417 - protein, 474 aa, Homo sapiens; identical to SEQ ID NO: 1413

SEQ ID NO: 1418 - protein, 375 aa, Homo sapiens [sequence omitted]

SEQ ID NO: 1419 - protein, 1515 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1420 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAGKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1421 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1422 - protein, 1518 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKVVLSASQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1423 - protein, 1516 aa, Homo sapiens
MAPILSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1424 - protein, 1535 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKVVLSASQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 1425 - protein, 1532 aa, Homo sapiens; identical to SEQ ID NO: 1421

SEQ ID NO: 1426 - protein, 1532 aa, Homo sapiens; identical to SEQ ID NO: 1421

SEQ ID NO: 1427 - protein, 1532 aa, Homo sapiens; identical to SEQ ID NO: 1421

SEQ ID NO: 1428 - protein, 211 aa, Homo sapiens
MILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 1429 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 1430 - protein, 253 aa, Homo sapiens; identical to SEQ ID NO: 1429

SEQ ID NO: 1431 - protein, 253 aa, Homo sapiens; identical to SEQ ID NO: 1429

SEQ ID NO: 1432 - protein, 253 aa, Homo sapiens; identical to SEQ ID NO: 1429

SEQ ID NO: 1433 - protein, 253 aa, Homo sapiens; identical to SEQ ID NO: 1429

SEQ ID NO: 1434 - protein, 456 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNARAGVNASPQQDSIFF

SEQ ID NO: 1435 - protein, 1060 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 1436 - protein, 1116 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 1437 - protein, 1116 aa, Homo sapiens; identical to SEQ ID NO: 1436

SEQ ID NO: 1438 - protein, 1174 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 1439 - protein, 1179 aa, Homo sapiens
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 1440 - protein, 1174 aa, Homo sapiens; identical to SEQ ID NO: 1438

SEQ ID NO: 1441 - protein, 134 aa, Homo sapiens [sequence omitted]

SEQ ID NO: 1442 - protein, 475 aa, Homo sapiens
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 1443 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 1444 - protein, 509 aa, Homo sapiens; identical to SEQ ID NO: 1443

SEQ ID NO: 1445 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGTDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 1446 - protein, 500 aa, Homo sapiens
MGTARWLALGSLFALAGLLEGRLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKSSSPLSSTRSKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 1447 - protein, 500 aa, Homo sapiens; identical to SEQ ID NO: 1446

SEQ ID NO: 1448 - protein, 698 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEAEREYVFKNLPFKV

SEQ ID NO: 1449 - protein, 1179 aa, Homo sapiens
MAACGRVRRMFRLSAALHLLLLFAAGAEKLPGHGVHSQGQGPGANFVSFVGQAGGGGPAGQQLPQLLQSSQLQQQQQQQQQQQQLQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 1450 - protein, 1203 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 1451 - protein, 1179 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 1452 - protein, 1179 aa, Homo sapiens; identical to SEQ ID NO: 1451

SEQ ID NO: 1453 - protein, 844 aa, Homo sapiens [sequence omitted]

SEQ ID NO: 1454 - protein, 1002 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFEAGLRMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRNPAAAPATGNKKTH

SEQ ID NO: 1455 - protein, 427 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVRPRERRARQIVKAPCSSMEFRSPT

SEQ ID NO: 1456 - protein, 1023 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 1457 - protein, 1023 aa, Homo sapiens; identical to SEQ ID NO: 1456

SEQ ID NO: 1458 - protein, 569 aa, Homo sapiens [sequence omitted]

SEQ ID NO: 1459 - protein, 559 aa, Homo sapiens
GPLPPLSPPPPSLSRRRLCHPRMPILANLPGMSSPRTMDLASLIKQNLRMDWNLQAQAQPTLRPPKQAVWKPSTDGLSMARLRRNGTPTIHAPRLQWKISLHVDSPSIHPSHLTLGGENAKIKTGYKQEHINLDCDIDFDIAGPSIRGALVLGYKGWLAGYQMNFETAKSRVTQSNFAVGYETDEFWLHTNVNDGTEFGSLIYQKVNKKLETAVNLAWTAGNSNTRFGIAAKYQIDPDACFSAKVNNSSLIGLGYTQTLKPGIKLTLSALLDGKNVNAGGHKLGLGLEFQAMNTVQLFNFKLFCSIATFRICIFCCMSWMQVLLNMLALQVKVDSALRCYPSGGTEETHFQKKSFQWTRGELGGHFEMPGFFFIKWLQVEADNMALCKFILSKMKFFPENTLVSPLRRGSLLDVVYKLTMGLFTDLHDLFPPQFIITSFTPKGLQGGVTVSFVPFWGGEGGCDEANNSGLIPSCVVFVFFFCPCTRVNRFQELHLAWKCLCDCNHMVTTLRIIGLLLCSHHSICFLAVWVHFRVFHFVWNILPFKCCNHHLKKTIKYNL

SEQ ID NO: 1460 - protein, 1014 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAAIAALERVKIRPMEHCCCSVRIPCPSSPEELGKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 1461 - protein, 455 aa, Homo sapiens
  VARIANT (1)...(455): Xaa = Any Amino Acid
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGXXXXXXXHDYKSNLPFFGSGCDQSECQ

SEQ ID NO: 1462 - protein, 994 aa, Homo sapiens [sequence omitted]

SEQ ID NO: 1463 - protein, 245 aa, Homo sapiens
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQKIGIVGFCWGGTAVHHLMMKYSEFRAGVSVYGIVKDSEDIYNLKNPTLFIFAENDVVIPLKDVSLLTQKLKEHCKVEYQIKTFSGQTHGFVHRKREDCSPADKPYIDEARRNLIEWLNKYM

SEQ ID NO: 1464 - protein, 245 aa, Homo sapiens; identical to SEQ ID NO: 1463

SEQ ID NO: 1465 - protein, 654 aa, Homo sapiens [sequence omitted]

SEQ ID NO: 1466 - protein, 644 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 1467 - protein, 643 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 1468 - protein, 656 aa, Homo sapiens [sequence omitted]

SEQ ID NO: 1469 - protein, 623 aa, Homo sapiens
MPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 1470 - protein, 666 aa, Homo sapiens
MAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 1471 - protein, 1288 aa, Homo sapiens [sequence omitted]

SEQ ID NO: 1472 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 1473 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNLRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 1474 - protein, 186 aa, Homo sapiens
TGGESHVSQRHPLPRPLPPAWCCPHSPQQGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 1475 - protein, 491 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 1476 - protein, 497 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLEALLLCQRTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 1477 - protein, 491 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 1478 - protein, 484 aa, Homo sapiens
SKRPCKCQSLEEQEKEDAGFCHHFSTQEKTPQICVVGSGPAGFYTAQHLLKQHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 1479 - protein, 437 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 1480 - protein, 437 aa, Homo sapiens; identical to SEQ ID NO: 1479

SEQ ID NO: 1481 - protein, 437 aa, Homo sapiens; identical to SEQ ID NO: 1479

SEQ ID NO: 1482 - protein, 437 aa, Homo sapiens; identical to SEQ ID NO: 1479

SEQ ID NO: 1483 - protein, 298 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 1484 - protein, 416 aa, Homo sapiens
MRTPRAVVSLVAPGHWPQMVPCGAASQERASVPPPLRKETPLSLGSAAAPGPSASRQGPKPGPPAATVARQTSRVSPAPPCSLRPGLRHESAPSAASDVTARGALRGLGCTVRVTAACGGNHGCSQSSALRIQSGKPLPDGAFLSGRPGDEGSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 1485 - protein, 298 aa, Homo sapiens; identical to SEQ ID NO: 1483

SEQ ID NO: 1486 - protein, 298 aa, Homo sapiens; identical to SEQ ID NO: 1483

SEQ ID NO: 1487 - protein, 313 aa, Homo sapiens
MAARRALHFVFKVGNRFQTARFYRDVLGMKVESCSVARLECSGAISAHCSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 1488 - protein, 313 aa, Homo sapiens; identical to SEQ ID NO: 1487

SEQ ID NO: 1489 - protein, 47 aa, Homo sapiens
PPFLFQCKLELQGVKGGVDHAAAFGRIAFSCPQKEVTLDTRSFELSD

SEQ ID NO: 1490 - protein, 285 aa, Homo sapiens
MCRGGGAMCAGEEERCAQGRGLQLWSLEVWGIGFGKARKRKGASGGPEVAREGGAGLVTPPVLGQNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 1491 - protein, 542 aa, Homo sapiens
MAAAAGAAAAPGSREPQDRPECGAGHPGPRYYRHPERWLLRPEAFLGPLRTRAPSAEDSQRERPAARSGPAMSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAEQARPHEGARPLRAVFTADGKLLSTGFSRMSERQLALWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 1492 - protein, 285 aa, Homo sapiens; identical to SEQ ID NO: 1490

SEQ ID NO: 1493 - protein, 154 aa, Homo sapiens
MGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 1494 - protein, 285 aa, Homo sapiens; identical to SEQ ID NO: 1490

SEQ ID NO: 1495 - protein, 271 aa, Homo sapiens
MSERQLALWDPERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 1496 - protein, 285 aa, Homo sapiens; identical to SEQ ID NO: 1490

SEQ ID NO: 1497 - protein, 704 aa, Homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVGEWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 1498 - protein, 704 aa, Homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 1499 - protein, 704 aa, Homo sapiens; identical to SEQ ID NO: 1498

SEQ ID NO: 1500 - protein, 698 aa, Homo sapiens
MARELRALLLWGRRLRPLLRAPALAAVPGGKPILCPRRTTAQLGPRRNPAWSLQAGRLFSTQTAEDKEEPLHSIISSSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 1501 - protein, 495 aa, Homo sapiens
MVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 1502 - protein, 564 aa, Homo sapiens
MEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 1503 - protein, 362 aa, Homo sapiens [sequence omitted]

SEQ ID NO: 1504 - protein, 362 aa, Homo sapiens [sequence omitted]

SEQ ID NO: 1505 - protein, 366 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1506 - protein, 362 aa, Homo sapiens [sequence omitted]

SEQ ID NO: 1507 - protein, 362 aa, Homo sapiens [sequence omitted]

SEQ ID NO: 1508 - protein, 359 aa, Homo sapiens
TAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTAARYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEATLRCWSLGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 1509 - protein, 365 aa, Homo sapiens [sequence omitted]

SEQ ID NO: 1510 - protein, 362 aa, Homo sapiens [sequence omitted]

SEQ ID NO: 1511 - protein, 365 aa, Homo sapiens
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRESLRIALRYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSDRKGGSYSQAASSDSAQGSDMSLTACKV

SEQ ID NO: 1512 - protein, 362 aa, Homo sapiens [sequence omitted]

SEQ ID NO: 1513 - protein, 362 aa, Homo sapiens
MRVTAPRTVLLLLSGALALTETWAGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 1514 - protein, 366 aa, Homo sapiens [sequence omitted]

SEQ ID NO: 1515 - protein, 365 aa, Homo sapiens
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSDRKGGSYSQAASSDSAQGSDMSLTACKV

SEQ ID NO: 1516 - protein, 366 aa, Homo sapiens [sequence omitted]

SEQ ID NO: 1517 - protein, 362 aa, Homo sapiens [sequence omitted]

SEQ ID NO: 1518 - protein, 362 aa, Homo sapiens
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 1519 - protein, 362 aa, Homo sapiens [sequence omitted]

SEQ ID NO: 1520 - protein, 362 aa, Homo sapiens
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 1521 - protein, 365 aa, Homo sapiens [sequence omitted]

SEQ ID NO: 1522 - protein, 362 aa, Homo sapiens
MRVTAPRTVLLLLSGALALTETWAGSHSMRYFYTAMSRPGRGEPRFIAVGYVDDTQFVRFDSDAASPRMAPRAPWIEQEGPEYWDRETQKYKRQAQTDRVSLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 1523 - protein, 2764 aa, Homo sapiens [sequence omitted]

SEQ ID NO: 1524 - protein, 2752 aa, Homo sapiens [sequence omitted]

SEQ ID NO: 1525 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPHMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 1526 - protein, 2813 aa, Homo sapiens [sequence omitted]

SEQ ID NO: 1527 - protein, 803 aa, Homo sapiens
MKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYIPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 1528 - protein, 704 aa, Homo sapiens
MKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVVRMRGSGRQCWMTETPNALLWHNVSGVGSCRWVRGLADFKDEATDFRVMPRDPSLHCHVTSTA

SEQ ID NO: 1529 - protein, 943 aa, Homo sapiens [sequence omitted]

SEQ ID NO: 1530 - protein, 704 aa, Homo sapiens; identical to SEQ ID NO: 1528

SEQ ID NO: 1531 - protein, 704 aa, Homo sapiens; identical to SEQ ID NO: 1528

SEQ ID NO: 1532 - protein, 803 aa, Homo sapiens; identical to SEQ ID NO: 1527

SEQ ID NO: 1533 - protein, 216 aa, Homo sapiens
MEGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1534 - protein, 218 aa, Homo sapiens
QFCQRWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1535 - protein, 457 aa, Homo sapiens
MKHLLLLLLCVFLVKSQGVNDNEEGFFSARGHRPLDKKREEAPSLRPAPPPISGGGYRARPAKAAATQKKLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1536 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIATNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1537 - protein, 512 aa, Homo sapiens [sequence omitted]

SEQ ID NO: 1538 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1539 - protein, 491 aa, Homo sapiens; identical to SEQ ID NO: 1538

SEQ ID NO: 1540 - protein, 432 aa, Homo sapiens
MKRMVSWSFHKLKTMKHLLLLLLCVFLVKSQGVNDNEEGFFSARGHRPLDKKREEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1541 - protein, 391 aa, Homo sapiens
MKHLLLLLLCVFLVKSQGVNDNEEGFFSARGHRPLDKKREEAPSLRPAPPPISGGGYRARPAKAAATQKKVERKAPDAGGCLHAETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1542 - protein, 344 aa, Homo sapiens
MYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 1543 - protein, 344 aa, Homo sapiens; identical to SEQ ID NO: 1542

SEQ ID NO: 1544 - protein, 445 aa, Homo sapiens [sequence omitted]

SEQ ID NO: 1545 - protein, 152 aa, Homo sapiens
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 1546 - protein, 152 aa, Homo sapiens; identical to SEQ ID NO: 1545

SEQ ID NO: 1547 - protein, 152 aa, Homo sapiens; identical to SEQ ID NO: 1545

SEQ ID NO: 1548 - protein, 153 aa, Homo sapiens
MAVLSKEYGFVLLTGAASFIMVAHLAINVSKARKKYKVEYPIMYSTDPENGHIFNCIQRAHQNTLEVYPPFLFFLAVGGVYHPLLAWAWPGLLDEFFMLMAITRENPASVVEEPWGPSPSWAWWAQLCALLSSILVGLKVAWAVDPNAAIKEL

SEQ ID NO: 1549 - protein, 152 aa, Homo sapiens; identical to SEQ ID NO: 1545

SEQ ID NO: 1550 - protein, 83 aa, Homo sapiens
MAARRGALIVLEGVDRAGKSTQSRKLVEALCAAGHRAELLRFPERSTEIGKLLSSYLQKKSDVEDHSVHLLFSANRWEQVIFP

SEQ ID NO: 1551 - protein, 254 aa, Homo sapiens [sequence omitted]

SEQ ID NO: 1552 - protein, 212 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 1553 - protein, 83 aa, Homo sapiens; identical to SEQ ID NO: 1550

SEQ ID NO: 1554 - protein, 80 aa, Homo sapiens
MAARRGALIVLEGVDRAGKSTQSRKLVEALCAAGHRAELLRFPERSTEIGKLLSSYLQKKSDVEDHSVHLLFSANRWEQV

SEQ ID NO: 1555 - protein, 212 aa, Homo sapiens; identical to SEQ ID NO: 1552

SEQ ID NO: 1556 - protein, 187 aa, Homo sapiens
MCRPHQRRLPSIGQMHCHSGEVADPIGRDGGARPGCGRGRTWYKRGGRPGSCRFADATAEENRVLLAMVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTE

SEQ ID NO: 1557 - protein, 250 aa, Homo sapiens
GFADDAAEENCVLLAMVNPTVFFDIAVDGEPLGRVSFELLADKVPKTAENFHALSTGEKGFGYKGSCFHRIIPGFMCQGGDFTRHNGTSGKSIYGEKFEDENFILKHTGPGILSMANAGPNTNGSQFFICTAKTEWLDGMHVICGKVKEGMNIVEVMECFGSRNGKTSKKITIADCGQLEVLVFYLNHQTIPSVAQESTPPSHLLAVSNLCALAAVPFGFHVFLVPSHALDCRVKFMIMKKLNNKKYIYI

SEQ ID NO: 1558 - protein, 105 aa, Homo sapiens [sequence omitted]

SEQ ID NO: 1559 - protein, 265 aa, Homo sapiens [sequence omitted]

SEQ ID NO: 1560 - protein, 232 aa, Homo sapiens
MCRPHQRRLPSIGQMHCHSGEVADPIGRDGGARPGCGRGRTWYKRGGRPGSCRFADATAEENRVLLAMVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 1561 - protein, 239 aa, Homo sapiens
ATRSPVVSAIVNPTVFFNIAINGEPLGCISFELFADKFPKTAENLRVLGMGEKGFGCKGSRFHRIIPGFMCQGGDFTRHNGTGGKSIYGEKFDDENFILKHTGPGILSMANAGPNTNGSQFFICTAKSEWLDGKHVVFGKMKEGINIVEATGRFGSRNGKTSKKITIADCGQLEVLVFYLNHQTLPFVAQESTLHPICLQYPRIFVLLLQFPLGSMFSLFPMPSIEELSVYDYEIKTKL

SEQ ID NO: 1562 - protein, 239 aa, Homo sapiens [sequence omitted]

SEQ ID NO: 1563 - protein, 105 aa, Homo sapiens
MCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 1564 - protein, 105 aa, Homo sapiens; identical to SEQ ID NO: 1563

SEQ ID NO: 1565 - protein, 252 aa, Homo sapiens [sequence omitted]

SEQ ID NO: 1566 - protein, 164 aa, Homo sapiens
VNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 1567 - protein, 241 aa, Homo sapiens
DAAAEENLVLLGMVNPTVFFDIAIDGEPLGRVSFLFADKFPKTAENFRALSTGEKGFSYKGSCFHRIILGFMYQGRDFTRHNGTGGKSIYGEKFEDENFILKHTGPGILSMANAGPNTNGSQFFICTAKTEWLDGKHVVFGKVKEGMNIMEAMERFGSRNGKTSKKITIADCGQLEVLVFYLNHQTIPSVVQENTLPPHLLAVSNLCALAAVPCFPCSLPCLAGLQSVYDYEIKTKQKNKK

SEQ ID NO: 1568 - protein, 105 aa, Homo sapiens; identical to SEQ ID NO: 1563

SEQ ID NO: 1569 - protein, 105 aa, Homo sapiens; identical to SEQ ID NO: 1563

SEQ ID NO: 1570 - protein, 227 aa, Homo sapiens
MWASLRAKVGAPLTCARRASGLGGVGDGLALAALPGAVEGLARREEEAFADAAATRSPVVSAIVNPTVFFNIAINGEPLGCISFELFADKFPKTAENLRVLGMGEKGFGCKGSRFHRIIPGFMCQGGDFTRHNGTGGKSIYGEKFDDENFILKHTGPGILSMANAGPNTNGSQFFICTAKSEWLDGKHVVFGKMKEGINIVEATGRFGSRNGKTSKKITIADCGQLE

SEQ ID NO: 1571 - protein, 786 aa, Homo sapiens
MSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 1572 - protein, 788 aa, Homo sapiens [sequence omitted]

SEQ ID NO: 1573 - protein, 495 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 1574 - protein, 495 aa, Homo sapiens; identical to SEQ ID NO: 1573

SEQ ID NO: 1575 - protein, 775 aa, Homo sapiens
MAPVGGGGRPVGGPARGRLLLAAPVLLVLLWALGARGQGSPQQGTIVGMRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 1576 - protein, 727 aa, Homo sapiens
MRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 1577 - protein, 669 aa, Homo sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 1578 - protein, 263 aa, Homo sapiens
MMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 1579 - protein, 602 aa, Homo sapiens
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 1580 - protein, 326 aa, Homo sapiens
MNTWVSAMPRKVIFPLLPTPTPPTSSTKLGVCFRFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 1581 - protein, 337 aa, Homo sapiens
MVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 1582 - protein, 669 aa, Homo sapiens; identical to SEQ ID NO: 1577

SEQ ID NO: 1583 - protein, 602 aa, Homo sapiens [sequence omitted]

SEQ ID NO: 1584 - protein, 330 aa, Homo sapiens
MSLIFLQQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 1585 - protein, 651 aa, Homo sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 1586 - protein, 602 aa, Homo sapiens; identical to SEQ ID NO: 1579

SEQ ID NO: 1587 - protein, 736 aa, Homo sapiens [sequence omitted]

SEQ ID NO: 1588 - protein, 366 aa, Homo sapiens
MEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 1589 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 1590 - protein, 882 aa, Homo sapiens; identical to SEQ ID NO: 1589

SEQ ID NO: 1591 - protein, 633 aa, Homo sapiens
MEILITVTDQNDNKPEFTQEVFKGSVMEGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 1592 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 1593 - protein, 894 aa, Homo sapiens
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 1594 - protein, 894 aa, Homo sapiens; identical to SEQ ID NO: 1593

SEQ ID NO: 1595 - protein, 894 aa, Homo sapiens
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDLVYTARPDERAIMTYVSCYYHAFAGAQKAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 1596 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1597 - protein, 477 aa, Homo sapiens
MLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIE

SEQ ID NO: 1598 - protein, 911 aa, Homo sapiens; identical to SEQ ID NO: 1596

SEQ ID NO: 1599 - protein, 901 aa, Homo sapiens
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDQLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSRDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 1600 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVGTLRPDEKAIMTYVSCFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1601 - protein, 576 aa, Homo sapiens
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDRLQLEFARRAAPFNNWLDGAVEDLQDVWLVHSVEETQSLLTAHDQFKATLPEAD

SEQ ID NO: 1602 - protein, 904 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 1603 - protein, 244 aa, Homo sapiens
LGTDPLAGCCSQPWLRAAGAGGAGRRGLGPGCLPPGAPREKTPQICVVGSGPAGFYTAQHLLKQHPQAHVDIYEKQPVPFGLVRFGVAPDHPEVKTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKRSPARGSG

SEQ ID NO: 1604 - protein, 65 aa, Homo sapiens
MGARGGLRALSRGRSRAGAGLEKGFCHHFSTQEKTPQICVVGSGPAGFYTAQHLLKGAPSYWLCS

SEQ ID NO: 1605 - protein, 75 aa, Homo sapiens
MVIGEEGFWWENEGVFSMQQRQALAQISLPRIICDNTGITTVSKNNIFMSNSYPRDFVNCSTLPALNLASWREAS

SEQ ID NO: 1606 - protein, 264 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRKNQIRKTSYAQHQQVRQIRKKMMEIMIREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 1607 - protein, 218 aa, Homo sapiens
MLVTRTQGTKIASDDLKGHVFEVSLADLQNDEVAFRKFKLITEDVQGKNCLTNFHGMDLTRDKTCSMVKKWQTMIEAHVDVKTTDGYLLHLFCVGFNKKRNNQIWKTSYAQHQQVRQIRKKMMEITTREVQTNDLKEVVNKLIPDSIGKDIEKACQSIYPLRDVFVRKVKMLKKPKFELGRLMELHGEGSSSGKATGDETGAKVGRADGYEPPVQESV

SEQ ID NO: 1608 - protein, 264 aa, Homo sapiens [sequence omitted]

SEQ ID NO: 1609 - protein, 244 aa, Homo sapiens [sequence omitted]

SEQ ID NO: 1610 - protein, 263 aa, Homo sapiens
AVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 1611 - protein, 218 aa, Homo sapiens [sequence omitted]

SEQ ID NO: 1612 - protein, 195 aa, Homo sapiens [sequence omitted]

SEQ ID NO: 1613 - protein, 259 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEIPDSIGKDIEKACQSIYPLHDVFVRKVKMLKKPKFELGKLMELHGEGSSSGKATGDETGAKVERADGYEPPVQESV

SEQ ID NO: 1614 - protein, 221 aa, Homo sapiens
EILERRSSPGPKEPVSSLFLGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 1615 - protein, 264 aa, Homo sapiens [sequence omitted]

SEQ ID NO: 1616 - protein, 263 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKWESSWSFMVKAVVLEKPLGTRQVLKLNELMDMNHQSKNLFKVQTSNSGK

SEQ ID NO: 1617 - protein, 264 aa, Homo sapiens; identical to SEQ ID NO: 1606

SEQ ID NO: 1618 - protein, 253 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRKNQIRKTSYAQHQQVRQIRKKMMEIMIREVQTNDLKEVVNKLIPDSIGKDIEKACQSIYPLHDVFFELGKLMELHGEGSSSGKATGDETGAKVERADGYEPPVQESV

SEQ ID NO: 1619 - protein, 980 aa, Homo sapiens
MGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 1620 - protein, 870 aa, Homo sapiens
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 1621 - protein, 712 aa, Homo sapiens
MCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 1622 - protein, 963 aa, Homo sapiens
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 1623 - protein, 86 aa, Homo sapiens
MVLWLKGVTFNVTTVDTKRRTETVQKLCPGGQLPFLLYGTEVHTDTNKIEEFLEAVLCPPRSGEGTPESPEGFRQLLNIPPPRRSG

SEQ ID NO: 1624 - protein, 241 aa, Homo sapiens
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 1625 - protein, 241 aa, Homo sapiens; identical to SEQ ID NO: 1624

SEQ ID NO: 1626 - protein, 240 aa, Homo sapiens
AEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 1627 - protein, 241 aa, Homo sapiens; identical to SEQ ID NO: 1624

SEQ ID NO: 1628 - protein, 248 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 1629 - protein, 282 aa, Homo sapiens
MYSFSCSLIWLSSPPHEERSIDIYYLPKNRLEAISNLTSGLESSRGFLSERRRQMADFDTYDDQAYSSFGSGRGSRGSAGGHGSRSQKELPTEPPYTAYVGNLPFNTVRGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFGDGPPLGGSNMDFREPTEEESAQRPRLQLKPRTVATPLNQVANPNSAIFGGARPREEVVQKEQK

SEQ ID NO: 1630 - protein, 248 aa, Homo sapiens; identical to SEQ ID NO: 1628

SEQ ID NO: 1631 - protein, 228 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 1632 - protein, 228 aa, Homo sapiens; identical to SEQ ID NO: 1631

SEQ ID NO: 1633 - protein, 282 aa, Homo sapiens
MYSFSCSLIWISSPPHEERSIDIYYLPKNRLEAISNLTSGLESSRGFLSERRRQMADFDTYDDQAYSSFGSGRGSRGSAGGHGSRSQKELPTEPPYTAYVGNLPFNTVRGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFGDGPPLGGSNMDFREPTEEESAQRPRLQLKPRTVATPLNQVANPNSAIFGGARPREEVVQKEQK

SEQ ID NO: 1634 - protein, 248 aa, Homo sapiens; identical to SEQ ID NO: 1628

SEQ ID NO: 1635 - protein, 248 aa, Homo sapiens; identical to SEQ ID NO: 1628

SEQ ID NO: 1636 - protein, 228 aa, Homo sapiens
MADFDTYDDQAYSSFGSGRGSRGSAGGHGSRSQKELPTEPPYTAYVGNLPFNTVRGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFGDGPPLGGSNMDFREPTEEESAQRPRLQLKPRTVATPLNQVANPNSAIFGGARPREEVVQKEQK

SEQ ID NO: 1637 - protein, 590 aa, Homo sapiens [sequence omitted]

SEQ ID NO: 1638 - protein, 507 aa, Homo sapiens
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKTIKDVFHNHGIHATTIQPEFASVGSKSSVVPCELACRTQCALKQCCGTLPQAPSGKDAEKTPAVSISCLELSNNLEKKPRRTKAENIPAVVIEIKNMPNKQPESSL

SEQ ID NO: 1639 - protein, 507 aa, Homo sapiens; identical to SEQ ID NO: 1638

SEQ ID NO: 1640 - protein, 507 aa, Homo sapiens
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATVHIKCEDPTSYMEVAKTIKDVFHNHGIHATTIQPEFASVGSKSSVVPCELACRTQCALKQCCGTLPQAPSGKDAEKTPAVSISCLELSNNLEKKPRRTKAENIPAVVIEIKNMPNKQPESSL

SEQ ID NO: 1641 - protein, 362 aa, Homo sapiens
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 1642 - protein, 653 aa, Homo sapiens [sequence omitted]

SEQ ID NO: 1643 - protein, 374 aa, Homo sapiens
  VARIANT (1)...(374): Xaa = Any Amino Acid
MEMTIPLNRHSWAQAEALWSRRDPLAWAVVWADSRGRFTTLCPAPRPLTLQARSVGQGVSRPWAAAVEEASVEYGSARYLLLCGLGGMLSCGLTHTAIVSLHLVKCRMQVDPGWYKGVLSGFGVTVHSDGLCGLARGCAQTFFGYSLQGFFKFGLYEVFKIRSAELLGPEKAYGWRAGLYLFAWASAEFFPDVSLEPMEAVKVRVQTRPGYASTLRATASRMXGEEGLWAFYKGVAPLWLRQIPYTMMKFACFERTVEDLYRYAVPKPQSQCTKAKQLGITFGGVFCAVVSHPADSVVSVLNKEKGIAALGVLRRLGFTGVWKGVVARIGLFAHIPMIGTLTALQWFIYDLVKVYFKLPRPPVAQAPEPLKKKK

SEQ ID NO: 1644 - protein, 231 aa, Homo sapiens
MQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 1645 - protein, 362 aa, Homo sapiens; identical to SEQ ID NO: 1641

SEQ ID NO: 1646 - protein, 361 aa, Homo sapiens
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 1647 - protein, 361 aa, Homo sapiens; identical to SEQ ID NO: 1646

SEQ ID NO: 1648 - protein, 362 aa, Homo sapiens; identical to SEQ ID NO: 1641

SEQ ID NO: 1649 - protein, 361 aa, Homo sapiens; identical to SEQ ID NO: 1646

SEQ ID NO: 1650 - protein, 516 aa, Homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 1651 - protein, 516 aa, Homo sapiens; identical to SEQ ID NO: 1650

SEQ ID NO: 1652 - protein, 516 aa, Homo sapiens; identical to SEQ ID NO: 1650

SEQ ID NO: 1653 - protein, 148 aa, Homo sapiens
MFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 1654 - protein, 204 aa, Homo sapiens
MDCVSEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 1655 - protein, 2225 aa, Homo sapiens
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 1656 - protein, 2225 aa, Homo sapiens [sequence omitted]

SEQ ID NO: 1657 - protein, 2225 aa, Homo sapiens; identical to SEQ ID NO: 1655

SEQ ID NO: 1658 - protein, 2225 aa, Homo sapiens; identical to SEQ ID NO: 1655

SEQ ID NO: 1659 - protein, 2225 aa, Homo sapiens; identical to SEQ ID NO: 1655

SEQ ID NO: 1660 - protein, 136 aa, Homo sapiens
MKKVGRKVVLTVKDGKTLNDELEITEGGRALHFSMLINTSKGHKCEFQDAYVLLSEKNISGVQSIVPALEIASAYLKPLVTIAEDIDEETLSTLILNRLKVGLQVVAAKVSGFGDNGASLKIWLLLLVVQCLEKRG

SEQ ID NO: 1661 - protein, 1481 aa, Homo sapiens [sequence omitted]

SEQ ID NO: 1662 - protein, 1482 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGSERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 1663 - protein, 1482 aa, Homo sapiens [sequence omitted]

SEQ ID NO: 1664 - protein, 1724 aa, Homo sapiens [sequence omitted]

SEQ ID NO: 1665 - protein, 1724 aa, Homo sapiens
MVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTAAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLTPTTRAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLEVKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 1666 - protein, 356 aa, Homo sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 1667 - protein, 236 aa, Homo sapiens [sequence omitted]

SEQ ID NO: 1668 - protein, 356 aa, Homo sapiens; identical to SEQ ID NO: 1666

SEQ ID NO: 1669 - protein, 488 aa, Homo sapiens
MDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 1670 - protein, 535 aa, Homo sapiens
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 1671 - protein, 534 aa, Homo sapiens
ASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 1672 - protein, 535 aa, Homo sapiens; identical to SEQ ID NO: 1670

SEQ ID NO: 1673 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENSREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGNGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILGPEGKPKKANIRDNGDGTYAVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKPEVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGRAGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 1674 - protein, 2692 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 1675 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 1676 - protein, 2735 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGRWRGEGVSRGTNMMMVGVHGPKTPCEEVYVKHMGNRVYNVTYTVKEKGDYILIVKWGDESVPGSPFKVKVP

SEQ ID NO: 1677 - protein, 366 aa, Homo sapiens
MVLQMEPQVNSTNNFHQGPLDQPVGPLTGLKSSLLKDTTSAGPLLRPYPASLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQNSLGTMQNRAGFPRDEDCLLLQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 1678 - protein, 222 aa, Homo sapiens
MAIFVELNTKAKMPIVGLGTWKSPLGKVKEVVKVAIDAGYRHIDCAYVYQNEHEVGEAIQEKIQEKAVKREDLFIINKLWPTFFERPLGYKSGDDFFRKDDKGNMIGGKAMFLDAWEAMEELVDEGLVKALGVSNFNHFQIERLLNKPGLKYKPVTNQVECHPYLTQEKLIQYCHSKGITIMAYSPLGSPDRLWAKPEDPSLLEDPKIKEIAARHKKPQPRF

SEQ ID NO: 1679 - protein, 55 aa, Homo sapiens [sequence omitted]

SEQ ID NO: 1680 - protein, 894 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 1681 - protein, 858 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFSELASRAPRPGQGPGPSSAAHGVAEARHCPDLWLRALGGGQVVLAAGGC

SEQ ID NO: 1682 - protein, 490 aa, Homo sapiens
MKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 1683 - protein, 702 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 1684 - protein, 898 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 1685 - protein, 894 aa, Homo sapiens; identical to SEQ ID NO: 1680

SEQ ID NO: 1686 - protein, 894 aa, Homo sapiens; identical to SEQ ID NO: 1680

SEQ ID NO: 1687 - protein, 639 aa, Homo sapiens
LEARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFSELASRAPRPGQGPGPSSAAHGVAEARHCPDLWLRALGGGQVVLAAGGC

SEQ ID NO: 1688 - protein, 690 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYTGFV

SEQ ID NO: 1689 - protein, 765 aa, Homo sapiens [sequence omitted]

SEQ ID NO: 1690 - protein, 672 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 1691 - protein, 648 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYG

SEQ ID NO: 1692 - protein, 702 aa, Homo sapiens; identical to SEQ ID NO: 1683

SEQ ID NO: 1693 - protein, 894 aa, Homo sapiens [sequence omitted]

SEQ ID NO: 1694 - protein, 658 aa, Homo sapiens
MVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 1695 - protein, 558 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 1696 - protein, 558 aa, Homo sapiens; identical to SEQ ID NO: 1695

SEQ ID NO: 1697 - protein, 172 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAGSLLEAQHDPGAQQGPAARGHGDHHVLQLPGLP

SEQ ID NO: 1698 - protein, 316 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 1699 - protein, 435 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 1700 - protein, 435 aa, Homo sapiens; identical to SEQ ID NO: 1699

SEQ ID NO: 1701 - protein, 435 aa, Homo sapiens; identical to SEQ ID NO: 1699

SEQ ID NO: 1702 - protein, 870 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 1703 - protein, 468 aa, Homo sapiens
RTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 1704 - protein, 872 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRQVPRGETGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 1705 - protein, 458 aa, Homo sapiens
RTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPRRPPPSAPARPFF

SEQ ID NO: 1706 - protein, 866 aa, Homo sapiens
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 1707 - protein, 866 aa, Homo sapiens; identical to SEQ ID NO: 1706

SEQ ID NO: 1708 - protein, 178 aa, Homo sapiens [sequence omitted]

SEQ ID NO: 1709 - protein, 177 aa, Homo sapiens
AQDQGEKENPMRELRIRKLCLNICVGESGDRLTRAAKVLEQLTGQTPVFSKARYTVRSFGIRRNEKIAVHCTVRGAKAEEILEKGLKVREYELRKNNFSDTGNFGFGIQEHIDLGIKYDPSIGIYGLDFYVVLGRPGFSIADKKRRTGCIGAKHRISKEEAMRWFQQKYDGIILPGK

SEQ ID NO: 1710 - protein, 178 aa, Homo sapiens [sequence omitted]

SEQ ID NO: 1711 - protein, 133 aa, Homo sapiens
MAQDQGEKENPMRELRIRKLCLNICVGESGDRLTRAAKVLEQLTGQTPVFSKARYTVRSFGIRRNEKIAVHCTVRGAKAEEILEKGLKVREYELRKNNFSDTGNFGFGIQEHIDLGIKYDPSIGIYGLDFYVV

SEQ ID NO: 1712 - protein, 189 aa, Homo sapiens
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 1713 - protein, 189 aa, Homo sapiens; identical to SEQ ID NO: 1712

SEQ ID NO: 1714 - protein, 185 aa, Homo sapiens
MRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 1715 - protein, 841 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGNCDTCGALQGLKGWPPPLCWPLTGWTAPCP

SEQ ID NO: 1716 - protein, 536 aa, Homo sapiens
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 1717 - protein, 906 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 1718 - protein, 906 aa, Homo sapiens; identical to SEQ ID NO: 1717

SEQ ID NO: 1719 - protein, 251 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 1720 - protein, 415 aa, Homo sapiens [sequence omitted]

SEQ ID NO: 1721 - protein, 230 aa, Homo sapiens [sequence omitted]

SEQ ID NO: 1722 - protein, 251 aa, Homo sapiens; identical to SEQ ID NO: 1719

SEQ ID NO: 1723 - protein, 620 aa, Homo sapiens
MSPPSPGRRREQRRPRAAATMATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 1724 - protein, 600 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 1725 - protein, 558 aa, Homo sapiens; identical to SEQ ID NO: 1695

SEQ ID NO: 1726 - protein, 489 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 1727 - protein, 498 aa, Homo sapiens
MTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 1728 - protein, 106 aa, Homo sapiens
MAQKRPACTLKPECVQQLLVCSQEAKKSAYCPYSHFPVGAALLTQEGRIFKGRVSLLPMLEVQWREPSSLQSQTPEFKLSSCLSLPSSWDYRVQHRKCLLPAGHLC

SEQ ID NO: 1729 - protein, 146 aa, Homo sapiens [sequence omitted]

SEQ ID NO: 1730 - protein, 146 aa, Homo sapiens [sequence omitted]

SEQ ID NO: 1731 - protein, 97 aa, Homo sapiens
MAQKRPACTLKPECVQQLLVCSQEAKKSAYCPYSHFPVGAALLTQEGRIFKGCNIENACYPLGICAERTAIQKAVSEGYKDFRAIAIASLAPTGPCT

SEQ ID NO: 1732 - protein, 696 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVK

SEQ ID NO: 1733 - protein, 519 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 1734 - protein, 519 aa, Homo sapiens; identical to SEQ ID NO: 1733

SEQ ID NO: 1735 - protein, 519 aa, Homo sapiens; identical to SEQ ID NO: 1733

SEQ ID NO: 1736 - protein, 262 aa, Homo sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKKVWPL

SEQ ID NO: 1737 - protein, 262 aa, Homo sapiens; identical to SEQ ID NO: 1736

SEQ ID NO: 1738 - protein, 365 aa, Homo sapiens [sequence omitted]

SEQ ID NO: 1739 - protein, 593 aa, Homo sapiens
MMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGWSRRLGRKLTLAWSPCCVSFNEVLFLYSGPFRFVDLYGAQKIVDRLKKYEAAYGKQFTPCQLLADHANSPNKKFYQ

SEQ ID NO: 1740 - protein, 763 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 1741 - protein, 763 aa, Homo sapiens; identical to SEQ ID NO: 1740

SEQ ID NO: 1742 - protein, 2432 aa, Homo sapiens [sequence omitted]

SEQ ID NO: 1743 - protein, 2480 aa, Homo sapiens [sequence omitted]

SEQ ID NO: 1744 - protein, 2427 aa, Homo sapiens [sequence omitted]

SEQ ID NO: 1745 - protein, 2452 aa, Homo sapiens [sequence omitted]

SEQ ID NO: 1746 - protein, 2472 aa, Homo sapiens [sequence omitted]

SEQ ID NO: 1747 - protein, 1121 aa, Homo sapiens
MSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 1748 - protein, 2472 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLTQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 1749 - protein, 2452 aa, Homo sapiens [sequence omitted]

SEQ ID NO: 1750 - protein, 861 aa, Homo sapiens
MGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 1751 - protein, 2438 aa, Homo sapiens [sequence omitted]

SEQ ID NO: 1752 - protein, 270 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 1753 - protein, 309 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 1754 - protein, 270 aa, Homo sapiens; identical to SEQ ID NO: 1752

SEQ ID NO: 1755 - protein, 309 aa, Homo sapiens; identical to SEQ ID NO: 1753

SEQ ID NO: 1756 - protein, 288 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLQSGQVFGLGRQIYDPKYCPQGTVADGAPSGTGDCPDPGEVPEYPPYYQEEAGY

SEQ ID NO: 1757 - protein, 308 aa, Homo sapiens
SSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 1758 - protein, 169 aa, Homo sapiens
PSEPGDPARLLQPERGRFSHHPDDVWLRRGVGRALPPRVPAGRLRRQGLHRLERGPALLDRGGHGGSDHPAQVGGGPCGGAVESLPGGHVRGVAPQIPGEREGDAAAHGIPIVGIIAGLVLFGAVITGAVVAAVRWRRKSSDRKGGSYSQAASSDSAQGSDVSLTACKV

SEQ ID NO: 1759 - protein, 365 aa, Homo sapiens [sequence omitted]

SEQ ID NO: 1760 - protein, 365 aa, Homo sapiens [sequence omitted]

SEQ ID NO: 1761 - protein, 46 aa, Homo sapiens
DLKALTPFWYLTGHFLPTDRKGGSYSQAASSDSAQGSDVSLTACKV

SEQ ID NO: 1762 - protein, 365 aa, Homo sapiens
MAVMGPRTLVLLLSGALALTQTWAGSHSMRYFSTSVSRPGRGEPRFIAVGYVDDTQFVRFDSDAASQRMEPRAPWIEQEGPEYWDEETGKVKAHSQTDRENLRIALRYYNQSEAGSHTLQMMFGCDVGSDGRFLRGYHQYAYDGKDYIALKEDLRSWTAADMAAQITKRKWEAAHVAEQQRAYLEGTCVDGLRRYLENGKETLQRADPPKTHMTHHPISDHEATLRCWALGFYPAEITLTWQRDGEDQTQDTELVETRPAGDGTFQKWAAVVVPSGEEQRYTCHVQHEGLPKPLTLRWEPSSQPTVPIVGIIAGLVLLGAVITGAVVAAVMWRRNSSDRKGGSYSQAASSDSAQGSDVSLTACKV

SEQ ID NO: 1763 - protein, 365 aa, Homo sapiens
MAVMPPRTLLLLLSGALALTQTWAGSHSMRYFFTSVSRPGRGEPRFIAVGYVDDSQFVQFDSDAASQRMEPRAPWIEQEEPEYWDEETRNVKAHSQTNRANLGTLRGYYNQSEDGSHTIQIMYGCDVGSDGRFLRGYRQDAYDGKDYIALNEDLRSWTAADMAAQITKRKWEAARRAEQLRAYLEGECVDGLRRYLENGKETLQRTDPPKTHMTHHPISDHEATLRCWALSFYPAEITLTWQRDGEDQTQDTELVETRPAGDGTFQKWAAVVVPSGKEKRYTCHVQHEGLPEPLTLRWEPSSQPTIPIVGIIAGLVLLGAVIAGAVVAAVMWRKKSSVRKGGSYSQAASSDSAQGSDVSLTACKV

SEQ ID NO: 1764 - protein, 362 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 1765 - protein, 371 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1766 - protein, 331 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 1767 - protein, 362 aa, Homo sapiens; identical to SEQ ID NO: 1764

SEQ ID NO: 1768 - protein, 356 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAVGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 1769 - protein, 365 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 1770 - protein, 349 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSAGLDASAQTTSHELTIPNDLIGCIIGRQGAKINEIRQMSGAQIKIANPVEGSTDRQVTITGSAASISLAQYLINVRLSSETGGMGSS

SEQ ID NO: 1771 - protein, 365 aa, Homo sapiens; identical to SEQ ID NO: 1769

SEQ ID NO: 1772 - protein, 393 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQVRADPLAASTANLSLLLQHPPLPAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1773 - protein, 318 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSAGLDASAQTTSHELTIPNDLIGCIIGRQGAKINEIRQMSGAQIKIANPVEGSTDRQVTITGSAASISLAQYLINVRLSSETGGMGSS

SEQ ID NO: 1774 - protein, 366 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 1775 - protein, 339 aa, Homo sapiens
MESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1776 - protein, 366 aa, Homo sapiens; identical to SEQ ID NO: 1774

SEQ ID NO: 1777 - protein, 356 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 1778 - protein, 370 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1779 - protein, 356 aa, Homo sapiens; identical to SEQ ID NO: 1777

SEQ ID NO: 1780 - protein, 345 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLEAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1781 - protein, 1205 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 1782 - protein, 1241 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 1783 - protein, 1170 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 1784 - protein, 1205 aa, Homo sapiens; identical to SEQ ID NO: 1781

SEQ ID NO: 1785 - protein, 1241 aa, Homo sapiens; identical to SEQ ID NO: 1782

SEQ ID NO: 1786 - protein, 956 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 1787 - protein, 957 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQVQGDDSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 1788 - protein, 956 aa, Homo sapiens; identical to SEQ ID NO: 1786

SEQ ID NO: 1789 - protein, 2328 aa, Homo sapiens [sequence omitted]

SEQ ID NO: 1790 - protein, 2137 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHTLCVDCEETSKWITDKTKVVESTKDLGRDLAGIIAIQRKLSGLERDVAAIQARVDALERESQQLMDSHPEQKENIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERDVHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 1791 - protein, 2137 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAGYRRELALRNELIRQEKLEQLARRFDRKAAMRETWLNENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRMSHLEQCFEELSNMAAGARTQLEQSKRLWKFFWEMDEAESWIKEKEQIYSSLDYGKDLTSVLILQRKHKAFEDELRGLDAHLEQIFQEAHGMVARNEFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHTLCVDCEETSKWITDKTKVVESTKDPGRDLAGIIAIQRKLSGLERDVAAIQARVDALERESQQLMDSHPEQKENIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 1792 - protein, 2106 aa, Homo sapiens [sequence omitted]

SEQ ID NO: 1793 - protein, 2106 aa, Homo sapiens [sequence omitted]

SEQ ID NO: 1794 - protein, 1509 aa, Homo sapiens [sequence omitted]

SEQ ID NO: 1795 - protein, 2363 aa, Homo sapiens [sequence omitted]

SEQ ID NO: 1796 - protein, 2328 aa, Homo sapiens [sequence omitted]

SEQ ID NO: 1797 - protein, 2137 aa, Homo sapiens [sequence omitted]

SEQ ID NO: 1798 - protein, 539 aa, Homo sapiens [sequence omitted]

SEQ ID NO: 1799 - protein, 197 aa, Homo sapiens
MDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEY

SEQ ID NO: 1800 - protein, 573 aa, Homo sapiens [sequence omitted]

SEQ ID NO: 1801 - protein, 713 aa, Homo sapiens
MLCVGRLGGLGARAAALPPRRAGRGSLEAGIRARRVSTSWSPVGAAFNVKPQGSRLDLFGERARLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKQKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNAQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPLVVLMLNLPRSSRSSPTLLTPGMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 1802 - protein, 371 aa, Homo sapiens
MLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSVRSNALGPPLLQWCDSCRKV

SEQ ID NO: 1803 - protein, 713 aa, Homo sapiens [sequence omitted]

SEQ ID NO: 1804 - protein, 608 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 1805 - protein, 645 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKARSQHYDLVLNGNEIGGGSIRIHNAELQRYILATLLKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 1806 - protein, 645 aa, Homo sapiens; identical to SEQ ID NO: 1805

SEQ ID NO: 1807 - protein, 338 aa, Homo sapiens
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 1808 - protein, 338 aa, Homo sapiens [sequence omitted]

SEQ ID NO: 1809 - protein, 338 aa, Homo sapiens; identical to SEQ ID NO: 1807

SEQ ID NO: 1810 - protein, 338 aa, Homo sapiens; identical to SEQ ID NO: 1807

SEQ ID NO: 1811 - protein, 174 aa, Homo sapiens
SSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 1812 - protein, 175 aa, Homo sapiens
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 1813 - protein, 175 aa, Homo sapiens; identical to SEQ ID NO: 1812

SEQ ID NO: 1814 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 1815 - protein, 198 aa, Homo sapiens; identical to SEQ ID NO: 1814

SEQ ID NO: 1816 - protein, 247 aa, Homo sapiens
MTALPAHRPPAHIQGNQKKETAQGRHRGSRCPCQRPSSHHSACFLGPEIMPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 1817 - protein, 247 aa, Homo sapiens
MTALPAHRPPAHIQGNQKKETAQGRHRGSRCPCQRPSSHHSACFLGPEIMPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIGNGQSG

SEQ ID NO: 1818 - protein, 3509 aa, Homo sapiens [sequence omitted]

SEQ ID NO: 1819 - protein, 4583 aa, Homo sapiens [sequence omitted]

SEQ ID NO: 1820 - protein, 4594 aa, Homo sapiens
EAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIREYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQRYLVYAILWSLSGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRLVEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWMNGLSVYQIKVHRKYTGEDFDEDLRTVLRRSGCKNEKIAFIMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDLEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIVNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKVNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMLRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVLLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDFSERIKQLQNISLAAASGGAKELKNIHVCLGGLFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 1821 - protein, 4588 aa, Homo sapiens [sequence omitted]

SEQ ID NO: 1822 - protein, 4649 aa, Homo sapiens [sequence omitted]

SEQ ID NO: 1823 - protein, 4646 aa, Homo sapiens [sequence omitted]

SEQ ID NO: 1824 - protein, 4236 aa, Homo sapiens [sequence omitted]

SEQ ID NO: 1825 - protein, 4241 aa, Homo sapiens [sequence omitted]

SEQ ID NO: 1826 - protein, 276 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 1827 - protein, 276 aa, Homo sapiens; identical to SEQ ID NO: 1826

SEQ ID NO: 1828 - protein, 276 aa, Homo sapiens; identical to SEQ ID NO: 1826

SEQ ID NO: 1829 - protein, 1121 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 1830 - protein, 994 aa, Homo sapiens [sequence omitted]

SEQ ID NO: 1831 - protein, 1027 aa, Homo sapiens [sequence omitted]

SEQ ID NO: 1832 - protein, 1027 aa, Homo sapiens [sequence omitted]

SEQ ID NO: 1833 - protein, 994 aa, Homo sapiens [sequence omitted]

SEQ ID NO: 1834 - protein, 994 aa, Homo sapiens [sequence omitted]

SEQ ID NO: 1835 - protein, 496 aa, Homo sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 1836 - protein, 332 aa, Homo sapiens
MQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 1837 - protein, 496 aa, Homo sapiens; identical to SEQ ID NO: 1835

SEQ ID NO: 1838 - protein, 496 aa, Homo sapiens; identical to SEQ ID NO: 1835

SEQ ID NO: 1839 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 1840 - protein, 434 aa, Homo sapiens
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 1841 - protein, 434 aa, Homo sapiens; identical to SEQ ID NO: 1839

SEQ ID NO: 1842 - protein, 317 aa, Homo sapiens
MAVMRTLRAMAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPGEAFGCPSVPARIPCSCLIY

SEQ ID NO: 1843 - protein, 434 aa, Homo sapiens
MAMQKIFAREILDSRGNPTVEVDLHTAKGRFRAAVPSGASTGIYEALELRDGDKGRYLGKGVLKAVENINNTLGPALLQKKLSVADQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 1844 - protein, 434 aa, Homo sapiens; identical to SEQ ID NO: 1839

SEQ ID NO: 1845 - protein, 433 aa, Homo sapiens
SILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1846 - protein, 433 aa, Homo sapiens
AMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 1847 - protein, 434 aa, Homo sapiens; identical to SEQ ID NO: 1840

SEQ ID NO: 1848 - protein, 341 aa, Homo sapiens
MIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 1849 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1850 - protein, 341 aa, Homo sapiens; identical to SEQ ID NO: 1848

SEQ ID NO: 1851 - protein, 434 aa, Homo sapiens; identical to SEQ ID NO: 1849

SEQ ID NO: 1852 - protein, 434 aa, Homo sapiens; identical to SEQ ID NO: 1840

SEQ ID NO: 1853 - protein, 433 aa, Homo sapiens
SIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 1854 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 1855 - protein, 1293 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVVMYWLSLSF

SEQ ID NO: 1856 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 1857 - protein, 1390 aa, Homo sapiens; identical to SEQ ID NO: 1856

SEQ ID NO: 1858 - protein, 1408 aa, Homo sapiens; identical to SEQ ID NO: 1854

SEQ ID NO: 1859 - protein, 1390 aa, Homo sapiens; identical to SEQ ID NO: 1856

SEQ ID NO: 1860 - protein, 1390 aa, Homo sapiens [sequence omitted]

SEQ ID NO: 1861 - protein, 718 aa, Homo sapiens
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 1862 - protein, 718 aa, Homo sapiens [sequence omitted]

SEQ ID NO: 1863 - protein, 583 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 1864 - protein, 572 aa, Homo sapiens
MDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 1865 - protein, 566 aa, Homo sapiens
MDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 1866 - protein, 576 aa, Homo sapiens
PKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 1867 - protein, 583 aa, Homo sapiens; identical to SEQ ID NO: 1863

SEQ ID NO: 1868 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 1869 - protein, 604 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAMWGPKLYALFQMRSCQSSIKQM

SEQ ID NO: 1870 - protein, 99 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 1871 - protein, 154 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVALAGLLGFGLGKVSYIGVCQSKFHFFEDQLRGAGFGPQHNRHCLLTCEECKIKHGLSEKGDSQPSAS

SEQ ID NO: 1872 - protein, 99 aa, Homo sapiens; identical to SEQ ID NO: 1870

SEQ ID NO: 1873 - protein, 91 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVARKS

SEQ ID NO: 1874 - protein, 124 aa, Homo sapiens
GKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 1875 - protein, 167 aa, Homo sapiens
GKTEVNYTQLVDLHARYAECGLRILAFPCNQFGKQEPGSNEEIKEFAAGYNVKFDMFSKICVNGDDAHPLWKWMKIQPKGKGILGKTAWGLWGAAGDAHVHVLLFQCHQVELHQVPHRQERLRGEALRTHGGAPGDREGPAPLFLAPQVCGPARAPAHALGAFHRHS

SEQ ID NO: 1876 - protein, 124 aa, Homo sapiens; identical to SEQ ID NO: 1874

SEQ ID NO: 1877 - protein, 124 aa, Homo sapiens; identical to SEQ ID NO: 1874

SEQ ID NO: 1878 - protein, 197 aa, Homo sapiens
MSLGRLCRLLKPALLCGALAAPGLAGTMCASRDDWRCARSMHEFSAKDIDGHMVNLDKYRGFVCIVTNVASQCGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 1879 - protein, 548 aa, Homo sapiens
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 1880 - protein, 547 aa, Homo sapiens
MVLELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 1881 - protein, 548 aa, Homo sapiens; identical to SEQ ID NO: 1879

SEQ ID NO: 1882 - protein, 345 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRQFDEILEASDGIMVARGDLGIEIPAEKVFLAQKMMIGRCNRAGKPVICATQAYAGEHDQEAPPHSG

SEQ ID NO: 1883 - protein, 345 aa, Homo sapiens; identical to SEQ ID NO: 1882

SEQ ID NO: 1884 - protein, 537 aa, Homo sapiens
QHWRTSAAMLKPHSEAGTAFIQTQQLHAATADTFLEHMCHLDIHTPPIPAWNTGIICTISPASQSVEMLKEMIKSGTNVACLNFSHGTHEYHVETIKNMCTATESFAADPILYRPVALALDTKGPEIRTGLIKGSSTMEVGLKMGATLKIMLDNTYMKKCDENILWLDYKNICKVMEVGSKIYVDDGLISLQVKQKGADFLVTEVETGGSSGSKKGVNLPGAAVDLPAVSEDIQDLNFGVEQDVDMVFASFIRKASDVHEVREALGEKGKNIKTINTIENHVGVQRFDEILEASDGIMVARGNPGIEIPAEKVFLAQRMMIGRCSAGKPICDSDVASAVLNGADCIMLSGETAKADYLEAGRMQHLIAHEAEATIYHLQLFEELPPTGAHYRPHESHRRGCQRGLLQVLQWGHNRPHQVWQVCSPGGIPPTCPHHCCDTESPDSSGPPVPWHLPCAVQGPSPGGQGGCGPLGELGPECWQGPRLLEGRHVVIVLTGWRPGSGFTNTMRVVPVRWTPKPLLQRLSHLLSPNHPLGQQR

SEQ ID NO: 1885 - protein, 1583 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 1886 - protein, 1640 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 1887 - protein, 1640 aa, Homo sapiens; identical to SEQ ID NO: 1886

SEQ ID NO: 1888 - protein, 268 aa, Homo sapiens
MAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKKVYATSQQIFGAVKSLWTKSSKEESLPKPKEKTKLGSSSEIEVPAKTTHVLKHSVPLPTELSSEAKTKSESTSGATQFMPDPKLMDHGQSHPEDIDMYSTRS

SEQ ID NO: 1889 - protein, 268 aa, Homo sapiens; identical to SEQ ID NO: 1888

SEQ ID NO: 1890 - protein, 277 aa, Homo sapiens
MEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDRCPNLQAQMYRLTLRTSKEAVSQRLCELLSAQF

SEQ ID NO: 1891 - protein, 580 aa, Homo sapiens
MEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVVCL

SEQ ID NO: 1892 - protein, 863 aa, Homo sapiens
MEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1893 - protein, 304 aa, Homo sapiens
MEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKAN

SEQ ID NO: 1894 - protein, 939 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1895 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 1896 - protein, 1178 aa, Homo sapiens; identical to SEQ ID NO: 1895

SEQ ID NO: 1897 - protein, 1178 aa, Homo sapiens; identical to SEQ ID NO: 1895

SEQ ID NO: 1898 - protein, 1178 aa, Homo sapiens; identical to SEQ ID NO: 1895

SEQ ID NO: 1899 - protein, 1178 aa, Homo sapiens; identical to SEQ ID NO: 1895

SEQ ID NO: 1900 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVSEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 1901 - protein, 1178 aa, Homo sapiens; identical to SEQ ID NO: 1895

SEQ ID NO: 1902 - protein, 362 aa, Homo sapiens [sequence omitted]

SEQ ID NO: 1903 - protein, 362 aa, Homo sapiens [sequence omitted]

SEQ ID NO: 1904 - protein, 362 aa, Homo sapiens [sequence omitted]

SEQ ID NO: 1905 - protein, 362 aa, Homo sapiens [sequence omitted]

SEQ ID NO: 1906 - protein, 362 aa, Homo sapiens [sequence omitted]

SEQ ID NO: 1907 - protein, 362 aa, Homo sapiens [sequence omitted]

SEQ ID NO: 1908 - protein, 362 aa, Homo sapiens [sequence omitted]

SEQ ID NO: 1909 - protein, 362 aa, Homo sapiens [sequence omitted]

SEQ ID NO: 1910 - protein, 362 aa, Homo sapiens [sequence omitted]

SEQ ID NO: 1911 - protein, 362 aa, Homo sapiens [sequence omitted]

SEQ ID NO: 1912 - protein, 362 aa, Homo sapiens [sequence omitted]

SEQ ID NO: 1913 - protein, 362 aa, Homo sapiens [sequence omitted]

SEQ ID NO: 1914 - protein, 372 aa, Homo sapiens
MRVMAPQALLLLLSGALALIETWAGSHSMRYFYTAVSRPGRGEPRFIAVGYVDDTQFVRFDSDAASPRGEPRAPWVEQEGPEYWDRETQKYKRQAQADRVNLRKLRGYYNQSEAGSHTIQRMYGCDLGPDGRLLRGYNQFAYDGKDYIALNEDLRSWTAADTAAQISQRKLEAAREAEQLRAYLEGECVEWLRGYLENGKETLQRAERPKTHVTHHPVSDHEATLRCWALGFYPAEITLTWQRDGEDQTQDTELVETRPAGDGTFQKWAAVVVPSGQEQRYTCHVQHEGLQEPCTLRWKPSSQPTIPNLGIVSGPAVLAVLAVLAVLAVLGAVVAAVIHRRKSSGGKGGSCSQAASSNSAQGSDESLIACKA

SEQ ID NO: 1915 - protein, 366 aa, Homo sapiens [sequence omitted]

SEQ ID NO: 1916 - protein, 309 aa, Homo sapiens [sequence omitted]

SEQ ID NO: 1917 - protein, 362 aa, Homo sapiens [sequence omitted]

SEQ ID NO: 1918 - protein, 366 aa, Homo sapiens [sequence omitted]

SEQ ID NO: 1919 - protein, 192 aa, Homo sapiens [sequence omitted]

SEQ ID NO: 1920 - protein, 1143 aa, Homo sapiens
MYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1921 - protein, 1256 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1922 - protein, 1258 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1923 - protein, 1304 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1924 - protein, 1304 aa, Homo sapiens [sequence omitted]

SEQ ID NO: 1925 - protein, 960 aa, Homo sapiens
MIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1926 - protein, 1306 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1927 - protein, 242 aa, Homo sapiens
MAWQMMQLLLLALVTAAGSAQPRSARARTDLLNVCMNAKYHKTQPSPEDELYGQTHDVQGVLQEDQELGQPRKSKCEVVLAGKHVLCRPALGVVAQWKKNACCMTNTSQELHKDTSRLYNFNWDHCGKMEPACKRHFIQDTGLYECSPNLGPWIWQVNQSWRKERILNVPLCKEDCERWWEDCRTSYTCKSNWHKGWNWTSGINECPAWALCHTFEPYFPTPAALCEGLWSHSFKVSNYNYS

SEQ ID NO: 1928 - protein, 106 aa, Homo sapiens [sequence omitted]

SEQ ID NO: 1929 - protein, 57 aa, Homo sapiens [sequence omitted]

SEQ ID NO: 1930 - protein, 243 aa, Homo sapiens
MAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 1931 - protein, 106 aa, Homo sapiens [sequence omitted]

SEQ ID NO: 1932 - protein, 106 aa, Homo sapiens [sequence omitted]

SEQ ID NO: 1933 - protein, 508 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 1934 - protein, 508 aa, Homo sapiens; identical to SEQ ID NO: 1933

SEQ ID NO: 1935 - protein, 185 aa, Homo sapiens
MTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 1936 - protein, 508 aa, Homo sapiens; identical to SEQ ID NO: 1933

SEQ ID NO: 1937 - protein, 357 aa, Homo sapiens
METRLPPRNIQDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 1938 - protein, 185 aa, Homo sapiens; identical to SEQ ID NO: 1935

SEQ ID NO: 1939 - protein, 508 aa, Homo sapiens; identical to SEQ ID NO: 1933

SEQ ID NO: 1940 - protein, 799 aa, Homo sapiens
  VARIANT (1)...(799): Xaa = Any Amino Acid
MAFSGRARPCIIPENEEIPRAALNTVHEANGTEDERAVSKLQRRHSDVKVYKEFCDFYAKFNMANALASATCERCKGGFAPAETIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKDLTADAQELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKDKFVEIDLKPVCKHCYEKMPEEFKRRLAKREREAKDKDKQKKKKPAHPQRSREGPSAARPGGASGLHEEGRVRCGCRPDARASPLAAPAAAMSGAGLAAVVSCLRPQPGEEPQTHELTLIDLIICGSLEAINIHSIRWSRALRPVFLINFPESRQTFCQKVGLLCTLQGKLQPQDWTLLDELLQGLQTLLLMILWQASRGLFLHYHVEALTLRRISSFRQYKYDLVAAGKALEGMFCKLNHLLEHPHQLFFLYLLPTLSRFVSIGLYMPATSFLLLVLGFKALQLWMQLHEAGVGLEELRGVPDPSVPAPQHRMVSTQVPDRGWMALKLVALIYLILQLGCIALTNFXLDFLLAATMVLPLCRRAFGPWTLCAALLVLTSPAATLLGSPFLWRELQEAPLSLAKGWQLFLAALAQGALEHHTXGALLFPLLSLGLCPCXLLFWNVLFWK

SEQ ID NO: 1941 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 1942 - protein, 93 aa, Homo sapiens; identical to SEQ ID NO: 1941

SEQ ID NO: 1943 - protein, 93 aa, Homo sapiens; identical to SEQ ID NO: 1941

SEQ ID NO: 1944 - protein, 132 aa, Homo sapiens
GRACTGATQPGLGAASPQPPRAKNLFIKECFGTLGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 1945 - protein, 664 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 1946 - protein, 790 aa, Homo sapiens
MGGELGSACCGGQERVPGWGWNPLAKDGVPSSLNSKPSPLARPPPPQSRRSQRHRLGVFAGAPHLHQPTQIPRSDSARPRSPRLPGASREPAGRRTPTPSSLCPSTRAPRPFRDPCPAGSAANLPAMETPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 1947 - protein, 107 aa, Homo sapiens
VVSPRLAVPPEPCLPSQGSHCSSSGDPAEYNLRSRTVLCGTCGQPADKASASGSGAQVGGPISSGSSASSVTVTRSYRSVGGSGGGSFGDNLVTRSYLLGNSSPRTQ

SEQ ID NO: 1948 - protein, 760 aa, Homo sapiens
MGGELGSACCGGQERVPGWGWNPLAKDGVPSSLNSKPSPLARPPPPQSRRSQRHRLGVFAGAPHLHQPTQIPRSDSARPRSPRLPGASREPAGRRTPTPSSLCPSTRAPRPFRDPCPAGSAANLPAMETPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 1949 - protein, 634 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 1950 - protein, 132 aa, Homo sapiens; identical to SEQ ID NO: 1944

SEQ ID NO: 1951 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 1952 - protein, 201 aa, Homo sapiens
MALSWVLTVLSLLPLLEAQIPLCANLVPVPITNATLDQITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 1953 - protein, 294 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 1954 - protein, 319 aa, Homo sapiens [sequence omitted]

SEQ ID NO: 1955 - protein, 319 aa, Homo sapiens [sequence omitted]

SEQ ID NO: 1956 - protein, 294 aa, Homo sapiens; identical to SEQ ID NO: 1953

SEQ ID NO: 1957 - protein, 319 aa, Homo sapiens [sequence omitted]

SEQ ID NO: 1958 - protein, 293 aa, Homo sapiens [sequence omitted]

SEQ ID NO: 1959 - protein, 276 aa, Homo sapiens [sequence omitted]

SEQ ID NO: 1960 - protein, 347 aa, Homo sapiens [sequence omitted]

SEQ ID NO: 1961 - protein, 424 aa, Homo sapiens [sequence omitted]

SEQ ID NO: 1962 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 1963 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 1964 - protein, 1066 aa, Homo sapiens; identical to SEQ ID NO: 1962

SEQ ID NO: 1965 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRTRYYQIMPKYHAVRIREEERYPPPGSTLPTKKHWVTSWQTRDQYY

SEQ ID NO: 1966 - protein, 1051 aa, Homo sapiens; identical to SEQ ID NO: 1963

SEQ ID NO: 1967 - protein, 1051 aa, Homo sapiens; identical to SEQ ID NO: 1963

SEQ ID NO: 1968 - protein, 1066 aa, Homo sapiens; identical to SEQ ID NO: 1962

SEQ ID NO: 1969 - protein, 518 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 1970 - protein, 493 aa, Homo sapiens [sequence omitted]

SEQ ID NO: 1971 - protein, 696 aa, Homo sapiens
MGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 1972 - protein, 267 aa, Homo sapiens
MCGISHGLRCLSVIVLRELVAWFIKLFFIFSIQDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRYFWHMKLSQFKCESTPKEYHFSLCFNLSVAQAEGN

SEQ ID NO: 1973 - protein, 561 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGPRIAPGPKPKAQPGTRLRGSAGRSYFYLPPPLLVPPPDVLLQSLTLDSPPSPRPWSHSCPRPTSAPPHHLWTLESGINAVCHIN

SEQ ID NO: 1974 - protein, 588 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAP

SEQ ID NO: 1975 - protein, 707 aa, Homo sapiens [sequence omitted]

SEQ ID NO: 1976 - protein, 628 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGAVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 1977 - protein, 628 aa, Homo sapiens
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 1978 - protein, 244 aa, Homo sapiens [sequence omitted]

SEQ ID NO: 1979 - protein, 481 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1980 - protein, 558 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1981 - protein, 558 aa, Homo sapiens; identical to SEQ ID NO: 1980

SEQ ID NO: 1982 - protein, 597 aa, Homo sapiens
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1983 - protein, 557 aa, Homo sapiens
AALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1984 - protein, 169 aa, Homo sapiens
MVPAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDL

SEQ ID NO: 1985 - protein, 497 aa, Homo sapiens
RVHHPHPPIPLYPCAGPEQQRVPCGGRAKDLHPGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 1986 - protein, 714 aa, Homo sapiens
VQWLTPVIPALCQGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 1987 - protein, 487 aa, Homo sapiens
MLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 1988 - protein, 742 aa, Homo sapiens [sequence omitted]

SEQ ID NO: 1989 - protein, 691 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1990 - protein, 699 aa, Homo sapiens [sequence omitted]

SEQ ID NO: 1991 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1992 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 1993 - protein, 699 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1994 - protein, 742 aa, Homo sapiens [sequence omitted]

SEQ ID NO: 1995 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1996 - protein, 668 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGALMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1997 - protein, 425 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1998 - protein, 395 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1999 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2000 - protein, 361 aa, Homo sapiens; identical to SEQ ID NO: 1999

SEQ ID NO: 2001 - protein, 535 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 2002 - protein, 742 aa, Homo sapiens [sequence omitted]

SEQ ID NO: 2003 - protein, 493 aa, Homo sapiens; identical to SEQ ID NO: 1995

SEQ ID NO: 2004 - protein, 493 aa, Homo sapiens; identical to SEQ ID NO: 1995

SEQ ID NO: 2005 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 2006 - protein, 277 aa, Homo sapiens; identical to SEQ ID NO: 2005

SEQ ID NO: 2007 - protein, 277 aa, Homo sapiens; identical to SEQ ID NO: 2005

SEQ ID NO: 2008 - protein, 277 aa, Homo sapiens; identical to SEQ ID NO: 2005

SEQ ID NO: 2009 - protein, 277 aa, Homo sapiens; identical to SEQ ID NO: 2005

SEQ ID NO: 2010 - protein, 419 aa, Homo sapiens [sequence omitted]

SEQ ID NO: 2011 - protein, 482 aa, Homo sapiens
AQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 2012 - protein, 483 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 2013 - protein, 921 aa, Homo sapiens
MLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGAPAGSGGKERSENLSLRRSVSELSLQGRRRRQQERRQQALSMAPGAADAQIGTADPGDFDQLTQCLIQAPSNRPYFLLLQGYQDAQQHVFGRGGNSSGRGGSPAPYVDTFLNAPDILPRHCTVRAGPEHPAMVRPSRGAPVTHNGCLLLREAELHPGDLLGLGEHFLFMYKDPRTGGSGPARPPWLPARPGATPPGPGWAFSCRLCGRGLQERGEALAAYLDGREPVLRFRPREEEALLGEIVRAAAAGSGDLPPLGPATLLALCVQHSARELELGHLPRLLGRLARLIKEAVWEKIKEIGDRQPENHPEGVPEVPLTPEAVSVELRPLMLWMANTTELLSFVQEKVLEMEKEADQEDPQLCNDLELCDEAMALLDEVIMCTFQQSVYYLTKTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 2014 - protein, 176 aa, Homo sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLSLHRLAGQRGHPPCLQDDQAGGWGLHLHSHPRGLP

SEQ ID NO: 2015 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 2016 - protein, 180 aa, Homo sapiens; identical to SEQ ID NO: 2015

SEQ ID NO: 2017 - protein, 180 aa, Homo sapiens; identical to SEQ ID NO: 2015

SEQ ID NO: 2018 - protein, 158 aa, Homo sapiens
LILKQADCGSTLSRRAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 2019 - protein, 941 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 2020 - protein, 610 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 2021 - protein, 968 aa, Homo sapiens
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 2022 - protein, 616 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 2023 - protein, 610 aa, Homo sapiens; identical to SEQ ID NO: 2020

SEQ ID NO: 2024 - protein, 618 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 2025 - protein, 618 aa, Homo sapiens; identical to SEQ ID NO: 2024

SEQ ID NO: 2026 - protein, 639 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 2027 - protein, 645 aa, Homo sapiens
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 2028 - protein, 610 aa, Homo sapiens; identical to SEQ ID NO: 2020

SEQ ID NO: 2029 - protein, 431 aa, Homo sapiens
APNHFPFPSSPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQSRSSAFRPGTSSRPSSSLRSKVTAWPCGRSEPS

SEQ ID NO: 2030 - protein, 419 aa, Homo sapiens
MDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVTVKVPQKNS

SEQ ID NO: 2031 - protein, 517 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 2032 - protein, 201 aa, Homo sapiens [sequence omitted]

SEQ ID NO: 2033 - protein, 517 aa, Homo sapiens; identical to SEQ ID NO: 2031

SEQ ID NO: 2034 - protein, 253 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 2035 - protein, 253 aa, Homo sapiens; identical to SEQ ID NO: 2034

SEQ ID NO: 2036 - protein, 211 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITK

SEQ ID NO: 2037 - protein, 253 aa, Homo sapiens; identical to SEQ ID NO: 2034

SEQ ID NO: 2038 - protein, 124 aa, Homo sapiens [sequence omitted]

SEQ ID NO: 2039 - protein, 124 aa, Homo sapiens [sequence omitted]

SEQ ID NO: 2040 - protein, 253 aa, Homo sapiens; identical to SEQ ID NO: 2034

SEQ ID NO: 2041 - protein, 253 aa, Homo sapiens [sequence omitted]

SEQ ID NO: 2042 - protein, 496 aa, Homo sapiens [sequence omitted]

SEQ ID NO: 2043 - protein, 331 aa, Homo sapiens [sequence omitted]

SEQ ID NO: 2044 - protein, 854 aa, Homo sapiens [sequence omitted]

SEQ ID NO: 2045 - protein, 732 aa, Homo sapiens
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 2046 - protein, 731 aa, Homo sapiens
PEETQTQDQPMEEEEVETFAFQAEIAQLMSLIINTFYSNKEIFLRELISNSSDALDKIRYETLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 2047 - protein, 732 aa, Homo sapiens; identical to SEQ ID NO: 2045

SEQ ID NO: 2048 - protein, 85 aa, Homo sapiens
KWVTFISLLFLFSSAYSRGVFRRDAHKSEVAHRFKDLGEENFKALVLIAFAQYLQQCPFEDHVKLVNEVTEFAKTCVADESAENL

SEQ ID NO: 2049 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 2050 - protein, 471 aa, Homo sapiens; identical to SEQ ID NO: 2049

SEQ ID NO: 2051 - protein, 471 aa, Homo sapiens; identical to SEQ ID NO: 2049

SEQ ID NO: 2052 - protein, 430 aa, Homo sapiens
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 2053 - protein, 471 aa, Homo sapiens; identical to SEQ ID NO: 2049

SEQ ID NO: 2054 - protein, 471 aa, Homo sapiens; identical to SEQ ID NO: 2049

SEQ ID NO: 2055 - protein, 471 aa, Homo sapiens; identical to SEQ ID NO: 2049

SEQ ID NO: 2056 - protein, 257 aa, Homo sapiens [sequence omitted]

SEQ ID NO: 2057 - protein, 532 aa, Homo sapiens
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 2058 - protein, 532 aa, Homo sapiens; identical to SEQ ID NO: 2057

SEQ ID NO: 2059 - protein, 532 aa, Homo sapiens; identical to SEQ ID NO: 2057

SEQ ID NO: 2060 - protein, 572 aa, Homo sapiens
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 2061 - protein, 572 aa, Homo sapiens; identical to SEQ ID NO: 2060

SEQ ID NO: 2062 - protein, 572 aa, Homo sapiens; identical to SEQ ID NO: 2060

SEQ ID NO: 2063 - protein, 1112 aa, Homo sapiens
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 2064 - protein, 1153 aa, Homo sapiens
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 2065 - protein, 1114 aa, Homo sapiens [sequence omitted]

SEQ ID NO: 2066 - protein, 883 aa, Homo sapiens [sequence omitted]

SEQ ID NO: 2067 - protein, 1153 aa, Homo sapiens; identical to SEQ ID NO: 2064

SEQ ID NO: 2068 - protein, 88 aa, Homo sapiens
PWLSQRGSQRPLWARRSSFLVDCSKAGSNMLLIGVHGPTTPCEEVSMKHVGNQQYNVTYVVKERGDYVLAVKWGEEHIPGSPFHVTVP

SEQ ID NO: 2069 - protein, 88 aa, Homo sapiens; identical to SEQ ID NO: 2068

SEQ ID NO: 2070 - protein, 95 aa, Homo sapiens
DASLTSKGAGLSKAFVGQKSSFLVDCSKASSNMLLIRVHGPTTACEKVSMKHVGNQQYNVTYVVKERGHYVLAVKWGEEHIPGSPFHVTVPNSFL

SEQ ID NO: 2071 - protein, 87 aa, Homo sapiens
PLRGQGSQRPLWARRSSFLVDCSKAGSNMLLIGVHGPTTPCEEVSMKHVGNQQYNVTYVVKERGDYVLAVKWGEEHIPGSPFHVTVP

SEQ ID NO: 2072 - protein, 87 aa, Homo sapiens; identical to SEQ ID NO: 2071

SEQ ID NO: 2073 - protein, 87 aa, Homo sapiens; identical to SEQ ID NO: 2071

SEQ ID NO: 2074 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 2075 - protein, 567 aa, Homo sapiens
MRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 2076 - protein, 748 aa, Homo sapiens; identical to SEQ ID NO: 2074

SEQ ID NO: 2077 - protein, 748 aa, Homo sapiens; identical to SEQ ID NO: 2074

SEQ ID NO: 2078 - protein, 318 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 2079 - protein, 318 aa, Homo sapiens; identical to SEQ ID NO: 2078

SEQ ID NO: 2080 - protein, 317 aa, Homo sapiens
PKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 2081 - protein, 318 aa, Homo sapiens; identical to SEQ ID NO: 2078

SEQ ID NO: 2082 - protein, 318 aa, Homo sapiens; identical to SEQ ID NO: 2078

SEQ ID NO: 2083 - protein, 318 aa, Homo sapiens; identical to SEQ ID NO: 2078

SEQ ID NO: 2084 - protein, 318 aa, Homo sapiens; identical to SEQ ID NO: 2078

SEQ ID NO: 2085 - protein, 318 aa, Homo sapiens; identical to SEQ ID NO: 2078

SEQ ID NO: 2086 - protein, 345 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 2087 - protein, 319 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSVSADNSTCSLTEEIKRFLLRSRQVDAVSVKIKKNKVHSSRIILWLSQREGRETS

SEQ ID NO: 2088 - protein, 418 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGGIDILVNNASAISLTNTLDTPTKRLDLMMNVNTRGTYLASKACIPYLKKSKVAHILNISPPLNLNPVWFKQHCAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 2089 - protein, 345 aa, Homo sapiens; identical to SEQ ID NO: 2086

SEQ ID NO: 2090 - protein, 1212 aa, Homo sapiens [sequence omitted]

SEQ ID NO: 2091 - protein, 460 aa, Homo sapiens [sequence omitted]

SEQ ID NO: 2092 - protein, 456 aa, Homo sapiens
MSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVRQPGCLLEQLVLYDIYWSEEMEDRLQALEKDKPSLRVIS

SEQ ID NO: 2093 - protein, 456 aa, Homo sapiens; identical to SEQ ID NO: 2092

SEQ ID NO: 2094 - protein, 466 aa, Homo sapiens
TAPTAGRWGKGSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPCQLEALKLESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVRQPGCLLEQLVLYDIYWSEEMEDRLQALEKDKPSLRVIS

SEQ ID NO: 2095 - protein, 456 aa, Homo sapiens; identical to SEQ ID NO: 2092

SEQ ID NO: 2096 - protein, 456 aa, Homo sapiens; identical to SEQ ID NO: 2092

SEQ ID NO: 2097 - protein, 456 aa, Homo sapiens; identical to SEQ ID NO: 2092

SEQ ID NO: 2098 - protein, 170 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKVRLLADPTGAFGKETDLLLDDSLVSIFGNRRLKRFSMVVQDGIVKALNVEPDGTGLTCSLAPNIISQL

SEQ ID NO: 2099 - protein, 420 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEVQTRRGSRKLCSAGGRSRLRSGGGPGPPSAGCRRCAASGAPPAAVAPARRRSGSGRGAGMGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 2100 - protein, 214 aa, Homo sapiens
MGLAGVCALRRSAGYILVGGAGGQSAAAAARRCSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 2101 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 2102 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAQIVAHLWEYVMSIDSLQLGYAEDGHCKGDINPNIPYPTRLQWDIPGECQEVIETSLNTANLLANDVDFHSFPFVAFGKGIIKKCRTSPDTFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 2103 - protein, 773 aa, Homo sapiens; identical to SEQ ID NO: 2101

SEQ ID NO: 2104 - protein, 773 aa, Homo sapiens; identical to SEQ ID NO: 2101

SEQ ID NO: 2105 - protein, 919 aa, Homo sapiens [sequence omitted]

SEQ ID NO: 2106 - protein, 307 aa, Homo sapiens
SVEVVGVTSPSPAPVPASRCPSRSSHALRPRPACQRCSPPQLQHLGPGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 2107 - protein, 2541 aa, Homo sapiens [sequence omitted]

SEQ ID NO: 2108 - protein, 2541 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVRQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 2109 - protein, 2541 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVGQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 2110 - protein, 2541 aa, Homo sapiens [sequence omitted]

SEQ ID NO: 2111 - protein, 139 aa, Homo sapiens
LSSYSPRGPQDGKIKNHYFRAFGSSYVITHLSVLKAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 2112 - protein, 768 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLARQA

SEQ ID NO: 2113 - protein, 766 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLAT

SEQ ID NO: 2114 - protein, 12 aa, Homo sapiens
IRCLKCTRKRRN

SEQ ID NO: 2115 - protein, 727 aa, Homo sapiens
MLRIPVRRALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNAWIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEFSPNLVRYDDIEGANYFQQANELSKLVNQQLLADPLVPPQLTLKDFYMTDSISRASQTMAKCVKAVTEGAQAVEEPSIC

SEQ ID NO: 2116 - protein, 727 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEFSPNLVRYDDIEGANYFQQANELSKLVNQQLLADPLVPPQLTIKDFYMTDSISRASQTMAKCVKAVTEGAQAVEEPSIC

SEQ ID NO: 2117 - protein, 17 aa, Homo sapiens
EGIKCLQCTRMPLALGI

SEQ ID NO: 2118 - protein, 727 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 2119 - protein, 741 aa, Homo sapiens
MRIRGSSGTLSRINMLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 2120 - protein, 415 aa, Homo sapiens
MMLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 2121 - protein, 414 aa, Homo sapiens [sequence omitted]

SEQ ID NO: 2122 - protein, 415 aa, Homo sapiens; identical to SEQ ID NO: 2120

SEQ ID NO: 2123 - protein, 415 aa, Homo sapiens; identical to SEQ ID NO: 2120

SEQ ID NO: 2124 - protein, 415 aa, Homo sapiens; identical to SEQ ID NO: 2120

SEQ ID NO: 2125 - protein, 415 aa, Homo sapiens; identical to SEQ ID NO: 2120

SEQ ID NO: 2126 - protein, 415 aa, Homo sapiens; identical to SEQ ID NO: 2120

SEQ ID NO: 2127 - protein, 1573 aa, Homo sapiens
MDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 2128 - protein, 1573 aa, Homo sapiens; identical to SEQ ID NO: 2127

SEQ ID NO: 2129 - protein, 1609 aa, Homo sapiens [sequence omitted]

SEQ ID NO: 2130 - protein, 467 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 2131 - protein, 467 aa, Homo sapiens; identical to SEQ ID NO: 2130

SEQ ID NO: 2132 - protein, 362 aa, Homo sapiens
MHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 2133 - protein, 467 aa, Homo sapiens; identical to SEQ ID NO: 2130

SEQ ID NO: 2134 - protein, 862 aa, Homo sapiens
MDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 2135 - protein, 862 aa, Homo sapiens; identical to SEQ ID NO: 2134

SEQ ID NO: 2136 - protein, 1028 aa, Homo sapiens
MDSALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKKLLQFYAETCPAPQRGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEDSNAQVTTENQLKYLTRLLSVEGSTLREALTHRKIIAKGEELLSPLNLEQAAYARNALAKAVYSRTFTWLVGKINRSLASKDVESPSWRSTTVLGLLDIYGFEVFQHNSFEQFCINYCNEKLQQLFIELPLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTYWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADIKQKGDVVLQSDHVIETLTKTALSANRVNSININQGSITFAGGPGRDGTIDFTPGSELLITKAKNGHLAVVAPRLNYR

SEQ ID NO: 2137 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 2138 - protein, 269 aa, Homo sapiens
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 2139 - protein, 306 aa, Homo sapiens [sequence omitted]

SEQ ID NO: 2140 - protein, 269 aa, Homo sapiens; identical to SEQ ID NO: 2138

SEQ ID NO: 2141 - protein, 263 aa, Homo sapiens; identical to SEQ ID NO: 2137

SEQ ID NO: 2142 - protein, 124 aa, Homo sapiens
MGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 2143 - protein, 176 aa, Homo sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 2144 - protein, 205 aa, Homo sapiens
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 2145 - protein, 205 aa, Homo sapiens; identical to SEQ ID NO: 2144

SEQ ID NO: 2146 - protein, 174 aa, Homo sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDAGPSCPRKSSGQHQNDKGKNVRQRNSS

SEQ ID NO: 2147 - protein, 410 aa, Homo sapiens [sequence omitted]

SEQ ID NO: 2148 - protein, 529 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 2149 - protein, 631 aa, Homo sapiens
MELQPPEASIAVVSIPRQLPGSHSEAGVQGLSAGDDSETGSDCVTQAGLQLLASSDPPALASKNAEVTVETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 2150 - protein, 568 aa, Homo sapiens
MELQPPEASIAVVSIPRQLPGSHSEAGVQGLSAGDDSGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 2151 - protein, 398 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQVLLAVFLSQGGCLSILQ

SEQ ID NO: 2152 - protein, 529 aa, Homo sapiens; identical to SEQ ID NO: 2148

SEQ ID NO: 2153 - protein, 398 aa, Homo sapiens; identical to SEQ ID NO: 2151

SEQ ID NO: 2154 - protein, 630 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 2155 - protein, 241 aa, Homo sapiens [sequence omitted]

SEQ ID NO: 2156 - protein, 231 aa, Homo sapiens
ATAAGSPVLSAMVNPTVLQHCRRQALGPRLLQPVCRQDSKDSRKLSCSEHWRERIWFGFPLSQNYSRVYVSGWLHTHNGTGGKSIYGEKFGDENFILKHTGPGILSMANAGPNTNGSQFFICTAKTEWLDGKHVVCGKAKEGKNIVEAMERCGSRNGKTSKKITIADCEQLVLVFYLNHQTIPSVAQESTPPPHLLSVSNLCALAAVPFGFHVFLVPFRALDCSVKFMIMN

SEQ ID NO: 2157 - protein, 233 aa, Homo sapiens
VLPAMVNPTVFFHISVDGESLGRISFELFADKFPKTAENFCALNTGEKGFGYKGCCFHRIIPGFMCHGGDFTHHNGTGGKSIYGEKVDDDNFILKHTGPGILSMANAGPNTNGSQFFICTAKSEWLDSKHVVIGKVKEGMNIVEAMEHFGSRNGKTSKKVTIPDFGQLEVLVFYLNHWTIPSAAQESSPPPHLLAVFNLCALAAVPFGFHVFLVPFHALDGRVKFVIMKKLNK

SEQ ID NO: 2158 - protein, 228 aa, Homo sapiens
EPCTISHGPHHVLHRREPLDCVSFELFADKVSKTAENFRALSTGEKGFGCKGSCFHRIIPGFMCQGGDFTCHNGTGGKSIYWEKFDDENFILKHTGPGILSMANAGPNTNGSQFFICTAKTKWLDGKHVAFGKVKEGMNIVEAMEGPGMARPARRSPLLTVDNSNKFDLCFILTSRPFLLLRRASFHPICSQYPRIFVLSLQFPLGAMFSLFPSMPSWIAELSLLNKN

SEQ ID NO: 2159 - protein, 167 aa, Homo sapiens
MERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQASCK

SEQ ID NO: 2160 - protein, 510 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 2161 - protein, 402 aa, Homo sapiens
MERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 2162 - protein, 510 aa, Homo sapiens; identical to SEQ ID NO: 2160

SEQ ID NO: 2163 - protein, 191 aa, Homo sapiens
MERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQASITQSRPAPFTSAPPAPTSCCFLFQIQ

SEQ ID NO: 2164 - protein, 522 aa, Homo sapiens
MGREELFLTFSFSSGFQESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 2165 - protein, 77 aa, Homo sapiens
MEKCKDAGLAKSIGVSNFNHRLLEMILNKPGLKYKPVCNQVECHPYFNQRKLLDFCKSKDIVLVAYSALGSHREEPW

SEQ ID NO: 2166 - protein, 53 aa, Homo sapiens
MILNKPGLKYKPVCNQVECHPYFNQRKLLDFCKSKDIVLVAYSALGSHREEPW

SEQ ID NO: 2167 - protein, 70 aa, Homo sapiens
SREGASGQRWEEWGTEWYGLGCEGSCLFFTSTCQPLPLYSPQLEKYQQGDFGYCPRVYCENQPMLPIGEC

SEQ ID NO: 2168 - protein, 215 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 2169 - protein, 215 aa, Homo sapiens; identical to SEQ ID NO: 2168

SEQ ID NO: 2170 - protein, 125 aa, Homo sapiens [sequence omitted]

SEQ ID NO: 2171 - protein, 234 aa, Homo sapiens
MEKCKGTSRMAGTTSADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 2172 - protein, 392 aa, Homo sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 2173 - protein, 392 aa, Homo sapiens
MEWWASSPLRLWLLLFLLPSAQGRQKESGSKWKVFIDQINRSLENYEPCSSQNCSCYHGVIEEDLTPFRGGISRRMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNTKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 2174 - protein, 164 aa, Homo sapiens
MYSDVWKQLKEEKKVRLELEKELELQIGMKTEMEIAMKLLEKDTHEKQDTLVALRQQLEEVKAINLQMFHKAQRLQHSERARQGAEERSHKLQQELGGRIGALQLQLSQLHEQCSSLEKELKSEKEQRQALQRELQHEKDTSSLLRMELQQVEGLKKGPRLAER

SEQ ID NO: 2175 - protein, 600 aa, Homo sapiens
MMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 2176 - protein, 347 aa, Homo sapiens [sequence omitted]

SEQ ID NO: 2177 - protein, 466 aa, Homo sapiens
  VARIANT (1)...(466): Xaa = Any Amino Acid
VNCETSCVQQPPCFPLKIPPNDPRIKNQADCIPFFRSXPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREA

SEQ ID NO: 2178 - protein, 466 aa, Homo sapiens
VNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREA

SEQ ID NO: 2179 - protein, 472 aa, Homo sapiens [sequence omitted]

SEQ ID NO: 2180 - protein, 471 aa, Homo sapiens [sequence omitted]

SEQ ID NO: 2181 - protein, 472 aa, Homo sapiens
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 2182 - protein, 472 aa, Homo sapiens; identical to SEQ ID NO: 2181

SEQ ID NO: 2183 - protein, 472 aa, Homo sapiens; identical to SEQ ID NO: 2181

SEQ ID NO: 2184 - protein, 149 aa, Homo sapiens
MKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 2185 - protein, 166 aa, Homo sapiens
MASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 2186 - protein, 166 aa, Homo sapiens; identical to SEQ ID NO: 2185

SEQ ID NO: 2187 - protein, 166 aa, Homo sapiens; identical to SEQ ID NO: 2185

SEQ ID NO: 2188 - protein, 166 aa, Homo sapiens; identical to SEQ ID NO: 2185

SEQ ID NO: 2189 - protein, 1248 aa, Homo sapiens
MEPPGGSLGPGRETRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRKTEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 2190 - protein, 1248 aa, Homo sapiens [sequence omitted]

SEQ ID NO: 2191 - protein, 53 aa, Homo sapiens
IANRKAGCAVTSLLASELTKDDAMAAVPAKVSKNSETFPTILEEAKELVGRAS

SEQ ID NO: 2192 - protein, 1248 aa, Homo sapiens
MEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 2193 - protein, 329 aa, Homo sapiens
MATGQKLMRAVRVFEFGGPEVLKLRSDIAVPIPKDHQVLIKVHACGVNPVETYIRSGTYSRKPLLPYTPGSDVAGVIEAVGDNASAFKKGDRVFTSSTISGGYAEYALAADHTVYKLPEKLDFKQGAAIGIPYFTAYRALIHSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 2194 - protein, 329 aa, Homo sapiens; identical to SEQ ID NO: 2193

SEQ ID NO: 2195 - protein, 329 aa, Homo sapiens; identical to SEQ ID NO: 2193

SEQ ID NO: 2196 - protein, 329 aa, Homo sapiens; identical to SEQ ID NO: 2193

SEQ ID NO: 2197 - protein, 192 aa, Homo sapiens
MHLLSSACVKAGESVLVHGASGGVGLAACQIARAYGLKILGTAGTEEGQKIVLQNGAHEVFNHREVNYIDKIKKYVGEKGIDIIIEMLANVNLSKDLSLLSHGGRVIVVGSRGTIEINPRDTMAKESSIIGVTLFSSTKEEFQQYAAALQAGMEIGWLKPVIGSQYPLEKVAEAHENIIHGSGATGKMILLL

SEQ ID NO: 2198 - protein, 192 aa, Homo sapiens
MRIPLRTHTSNCLSYENFLLQNPCKFGIHLSTGLLHTFLHNALWCILGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 2199 - protein, 277 aa, Homo sapiens
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 2200 - protein, 276 aa, Homo sapiens
SSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 2201 - protein, 79 aa, Homo sapiens
ILVLIKVHACGVNPVETYIRSGTYSRKPLLPYTPGSDVAGVIEAVGDNASAFKCLCESWRECSGSWGKWRSWISSMPNC

SEQ ID NO: 2202 - protein, 757 aa, Homo sapiens [sequence omitted]

SEQ ID NO: 2203 - protein, 140 aa, Homo sapiens
GHPEVLGPGLLPCGDHTDLAAGWGGPDPHTELVETRPAGDGTFQKWAAVVVPSGEEQRYTCHVQHEGLPEPLTLRWEPSSQPTIPIVGIVAGLVLLVAVVTGAVVAAVMWRKKSSDRKGGSYSQAASGNSAQGSDVSLTA

SEQ ID NO: 2204 - protein, 362 aa, Homo sapiens
MAVMAPRTLLLLLSGALALTQTWARSHSMRYFYTTMSRPGAGEPRFISVGYVDDTQFVRFDSDDASPREEPRAPWMEREGPKYWDRNTQICKAQAQTERENLRIALRYYNQSEGGSHTMQVMYGCDVGPDGPFLRGYEQHAYDGKDYIALNEDLRSWTAADMAAQITKRKWEAARRAEQRRVYLEGEFVEWLRRYLENGKETLQRADPPKTHMTHHPISDHEATLRCWALGFYPAEITLTWQRDGEDQTQDTELVETRPAGDGTFQKWAAVVVPSGEEQRYTCHVQHEGLPEPLTLRWEPSSQPTVPIVGIVAGLVLLVAVVTGAVVAAVMWRKKSSDRKGGSYSQAASSNSAQGSDVSLTA

SEQ ID NO: 2205 - protein, 392 aa, Homo sapiens [sequence omitted]

SEQ ID NO: 2206 - protein, 392 aa, Homo sapiens [sequence omitted]

SEQ ID NO: 2207 - protein, 399 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 2208 - protein, 349 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIGKQMVELNMPLTRLNQPLQQSREAE

SEQ ID NO: 2209 - protein, 348 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGYPKPEEGILDSLDVWVIAVIVIAIVVGVAVICVVPYRYLQRRKKKGTYLTDETHREVKFTSL

SEQ ID NO: 2210 - protein, 363 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGYPKPEEGILDSLDVWVIAVIVIAIVVGVAVICVVPYRYLQRRKKKGTYLTDETHREVKFTSL

SEQ ID NO: 2211 - protein, 362 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGTYLTDETHREVKFTSL

SEQ ID NO: 2212 - protein, 166 aa, Homo sapiens
EVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGTKVIFFLSWFVIVVAVHFRLYFFDINYQSYKITEKKQF

SEQ ID NO: 2213 - protein, 385 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 2214 - protein, 355 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGYPKPEEGILDSLDVWVIAVIVIAIVVGVAVICVVPYRYLQRRKKKGKADGGAEYATYQTKSTTPAEQRG

SEQ ID NO: 2215 - protein, 399 aa, Homo sapiens; identical to SEQ ID NO: 2207

SEQ ID NO: 2216 - protein, 384 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 2217 - protein, 369 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 2218 - protein, 377 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 2219 - protein, 370 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 2220 - protein, 373 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIDIFKGGRRKGKQMVELNMPLTRLNQPLQQSREAE

SEQ ID NO: 2221 - protein, 385 aa, Homo sapiens; identical to SEQ ID NO: 2213

SEQ ID NO: 2222 - protein, 370 aa, Homo sapiens; identical to SEQ ID NO: 2219

SEQ ID NO: 2223 - protein, 377 aa, Homo sapiens; identical to SEQ ID NO: 2218

SEQ ID NO: 2224 - protein, 355 aa, Homo sapiens; identical to SEQ ID NO: 2214

SEQ ID NO: 2225 - protein, 378 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGYPKPEEGILDSLDVWVIAVIVIAIVVGVAVICVVPYRYLQRRKKKGTYLTDETHREVKFTSL

SEQ ID NO: 2226 - protein, 378 aa, Homo sapiens; identical to SEQ ID NO: 2225

SEQ ID NO: 2227 - protein, 363 aa, Homo sapiens; identical to SEQ ID NO: 2210

SEQ ID NO: 2228 - protein, 373 aa, Homo sapiens; identical to SEQ ID NO: 2220

SEQ ID NO: 2229 - protein, 348 aa, Homo sapiens; identical to SEQ ID NO: 2209

SEQ ID NO: 2230 - protein, 148 aa, Homo sapiens
MQAIKCVVVGDGAVGKTCLLISYTTNAFPGEYIPTVFDNYSANVMVDSKPVNLGLWDTAGQEDYDRLRPLSYPQTWFPEVRHHCPSTPIILVGTKLDLRDDKDTIEKLKEKKLAPITYPQGLALAKEIDSVKYLECSALTQRGLKTVF

SEQ ID NO: 2231 - protein, 465 aa, Homo sapiens
STRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 2232 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 2233 - protein, 466 aa, Homo sapiens; identical to SEQ ID NO: 2232

SEQ ID NO: 2234 - protein, 559 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 2235 - protein, 559 aa, Homo sapiens; identical to SEQ ID NO: 2234

SEQ ID NO: 2236 - protein, 559 aa, Homo sapiens; identical to SEQ ID NO: 2234

SEQ ID NO: 2237 - protein, 651 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 2238 - protein, 493 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEPEGGSPPPTCTGDLRHPAQLRPPAPDPTQRLPGEAEEPMQTPKATHLGAGGLKHLPGVLVPF

SEQ ID NO: 2239 - protein, 766 aa, Homo sapiens
LQTCLHPQEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 2240 - protein, 845 aa, Homo sapiens [sequence omitted]

SEQ ID NO: 2241 - protein, 485 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAETCTGDLRHPAQLRPPAPDPTQRLPGEAEEPMQTPKATHLGAGGLKHLPGVLVPF

SEQ ID NO: 2242 - protein, 657 aa, Homo sapiens
LQTCLHPQEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTRCP

SEQ ID NO: 2243 - protein, 845 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTVQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 2244 - protein, 651 aa, Homo sapiens; identical to SEQ ID NO: 2237

SEQ ID NO: 2245 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 2246 - protein, 430 aa, Homo sapiens; identical to SEQ ID NO: 2245

SEQ ID NO: 2247 - protein, 430 aa, Homo sapiens; identical to SEQ ID NO: 2245

SEQ ID NO: 2248 - protein, 260 aa, Homo sapiens
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 2249 - protein, 265 aa, Homo sapiens
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 2250 - protein, 277 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 2251 - protein, 272 aa, Homo sapiens
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 2252 - protein, 276 aa, Homo sapiens
SDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 2253 - protein, 301 aa, Homo sapiens
MHPSRRSLPFPLNCQLARVGTADYGSPSDQSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 2254 - protein, 176 aa, Homo sapiens
NGRLQLSQHHQRVWGAPSPANFIQPGKQPLSSMCPTIMVGQDGQVRMVVGAAGGTQITTATALICVTAFLPGRAHPAQPPSHADHTPMPQAIIYNLWFGYDVKRAVEEPRLHNQLLPNVTTVERNIDQAVTAALETRHHHTQIASTFIAVVQAIVHTAGGWAAASDSRKGGEPAGY

SEQ ID NO: 2255 - protein, 252 aa, Homo sapiens
MTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFIQPGKQPLSSMCPTIMVGQDGQVRMVVGAAGGTQITTATALICVTPFLPGRAHPAQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 2256 - protein, 252 aa, Homo sapiens
MTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALVCVTPFLPGRAHPAQPPSHADHTPMPQAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 2257 - protein, 252 aa, Homo sapiens; identical to SEQ ID NO: 2256

SEQ ID NO: 2258 - protein, 225 aa, Homo sapiens
MTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 2259 - protein, 252 aa, Homo sapiens; identical to SEQ ID NO: 2256

SEQ ID NO: 2260 - protein, 74 aa, Homo sapiens
NGRLQLSQHHQRVWGAPSPANFIQPGKQPLSSMCPTIMVGQDGQVRMVVGAAGGTQITTATALICHHLQPLVRL

SEQ ID NO: 2261 - protein, 225 aa, Homo sapiens; identical to SEQ ID NO: 2258

SEQ ID NO: 2262 - protein, 225 aa, Homo sapiens; identical to SEQ ID NO: 2258

SEQ ID NO: 2263 - protein, 74 aa, Homo sapiens; identical to SEQ ID NO: 2260

SEQ ID NO: 2264 - protein, 225 aa, Homo sapiens; identical to SEQ ID NO: 2258

SEQ ID NO: 2265 - protein, 225 aa, Homo sapiens; identical to SEQ ID NO: 2258

SEQ ID NO: 2266 - protein, 74 aa, Homo sapiens; identical to SEQ ID NO: 2260

SEQ ID NO: 2267 - protein, 74 aa, Homo sapiens; identical to SEQ ID NO: 2260

SEQ ID NO: 2268 - protein, 74 aa, Homo sapiens; identical to SEQ ID NO: 2260

SEQ ID NO: 2269 - protein, 1130 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 2270 - protein, 1130 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNRNESYS

SEQ ID NO: 2271 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 2272 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 2273 - protein, 322 aa, Homo sapiens
ASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 2274 - protein, 352 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADVRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKMGFPNSSTLLLLILFKRTSKYKQQLVFLTGIFIVL

SEQ ID NO: 2275 - protein, 284 aa, Homo sapiens
MLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADVRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 2276 - protein, 323 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 2277 - protein, 323 aa, Homo sapiens; identical to SEQ ID NO: 2276

SEQ ID NO: 2278 - protein, 216 aa, Homo sapiens
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 2279 - protein, 208 aa, Homo sapiens
MKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 2280 - protein, 208 aa, Homo sapiens
LEGRALLQVRVGVLSESCVLGLVSFPCPCSGSVRQIGRLCSRPQEWCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 2281 - protein, 180 aa, Homo sapiens [sequence omitted]

SEQ ID NO: 2282 - protein, 179 aa, Homo sapiens
MALRSQFWGFSVCRNPGCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 2283 - protein, 241 aa, Homo sapiens
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 2284 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 2285 - protein, 259 aa, Homo sapiens; identical to SEQ ID NO: 2284

SEQ ID NO: 2286 - protein, 259 aa, Homo sapiens; identical to SEQ ID NO: 2284

SEQ ID NO: 2287 - protein, 1849 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFKAHASFYYPLLCEIMQFDLIPELRAVLRRFFLRIGVVFQISQPPEQELGINKQ

SEQ ID NO: 2288 - protein, 1849 aa, Homo sapiens; identical to SEQ ID NO: 2287

SEQ ID NO: 2289 - protein, 1849 aa, Homo sapiens; identical to SEQ ID NO: 2287

SEQ ID NO: 2290 - protein, 1785 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITEMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 2291 - protein, 1776 aa, Homo sapiens
MQESQTKSMFVSRALEKILADKEVKRPQHSQLRRACQVALGGLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITEMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 2292 - protein, 1785 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARRLEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITKMKQKNIDTIKTLITVAHTDGNYLGNSWHEILKCISQLELAQLIGTGVKTRYLSGSGREREGSLKGHTLAGEEFMGLGLGNLVSGGVNKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRISVVYKIWIPEEPSQVPAALSPVW

SEQ ID NO: 2293 - protein, 1181 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2294 - protein, 1226 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2295 - protein, 886 aa, Homo sapiens
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2296 - protein, 931 aa, Homo sapiens
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2297 - protein, 905 aa, Homo sapiens
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2298 - protein, 1226 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2299 - protein, 1200 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 2300 - protein, 1226 aa, Homo sapiens; identical to SEQ ID NO: 2294

SEQ ID NO: 2301 - protein, 931 aa, Homo sapiens; identical to SEQ ID NO: 2296

SEQ ID NO: 2302 - protein, 886 aa, Homo sapiens; identical to SEQ ID NO: 2295

SEQ ID NO: 2303 - protein, 417 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 2304 - protein, 417 aa, Homo sapiens; identical to SEQ ID NO: 2303

SEQ ID NO: 2305 - protein, 415 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 2306 - protein, 417 aa, Homo sapiens; identical to SEQ ID NO: 2303

SEQ ID NO: 2307 - protein, 414 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 2308 - protein, 414 aa, Homo sapiens; identical to SEQ ID NO: 2307

SEQ ID NO: 2309 - protein, 414 aa, Homo sapiens; identical to SEQ ID NO: 2307

SEQ ID NO: 2310 - protein, 414 aa, Homo sapiens; identical to SEQ ID NO: 2307

SEQ ID NO: 2311 - protein, 286 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDQRAGLSRWQDSRSRGCPRDCNPSLPHVPERTGDVHQSHCFHFCLDQRVSPQSKA

SEQ ID NO: 2312 - protein, 1013 aa, Homo sapiens
MAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPALPLPHFLLI

SEQ ID NO: 2313 - protein, 1238 aa, Homo sapiens
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPALPLPHFLLI

SEQ ID NO: 2314 - protein, 1527 aa, Homo sapiens
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 2315 - protein, 1013 aa, Homo sapiens; identical to SEQ ID NO: 2312

SEQ ID NO: 2316 - protein, 1238 aa, Homo sapiens
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSTLILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPALPLPHFLLI

SEQ ID NO: 2317 - protein, 1238 aa, Homo sapiens; identical to SEQ ID NO: 2313

SEQ ID NO: 2318 - protein, 1527 aa, Homo sapiens; identical to SEQ ID NO: 2314

SEQ ID NO: 2319 - protein, 583 aa, Homo sapiens [sequence omitted]

SEQ ID NO: 2320 - protein, 570 aa, Homo sapiens [sequence omitted]

SEQ ID NO: 2321 - protein, 532 aa, Homo sapiens [sequence omitted]

SEQ ID NO: 2322 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLMDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 2323 - protein, 1023 aa, Homo sapiens; identical to SEQ ID NO: 1456

SEQ ID NO: 2324 - protein, 1023 aa, Homo sapiens; identical to SEQ ID NO: 1456

SEQ ID NO: 2325 - protein, 208 aa, Homo sapiens
MRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 2326 - protein, 391 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 2327 - protein, 260 aa, Homo sapiens
MGPGVNLREMEEFPQPCGCCIPSRSQQCLSDQGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 2328 - protein, 136 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 2329 - protein, 121 aa, Homo sapiens
IGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 2330 - protein, 149 aa, Homo sapiens [sequence omitted]

SEQ ID NO: 2331 - protein, 5065 aa, Homo sapiens
MAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLNPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAELSATLEQAAATARVTFSGLRDTVTPGELLKAEIIDQDLYERLEHGQATAKDVGSLASAQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTALVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPAENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSDCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWVLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEPVPAGVVGSEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDARRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRASTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 2332 - protein, 2951 aa, Homo sapiens [sequence omitted]

SEQ ID NO: 2333 - protein, 2395 aa, Homo sapiens
MAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLDPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAKLSATLEQAAATARVTFSGLRDTVTPGELLKAEIIDQDLYERLEHGQATAKDVGSLASVQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTTLVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPVENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSGCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWLLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 2334 - protein, 408 aa, Homo sapiens
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 2335 - protein, 411 aa, Homo sapiens
MLLWGTWRRTTGGGISTTPTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 2336 - protein, 152 aa, Homo sapiens [sequence omitted]

SEQ ID NO: 2337 - protein, 60 aa, Homo sapiens
GGRIFLQDIKKPDCDDWESGLNAMECALHLEKNVNQSLLELHKLATDKNDPHLCDLRYIT

SEQ ID NO: 2338 - protein, 203 aa, Homo sapiens [sequence omitted]

SEQ ID NO: 2339 - protein, 130 aa, Homo sapiens
MEMWGKPQHACTALKNFAKYFLHQSHEEREHAEKLMKLQNQRGGRIFLQDIKKPDCDDWESGLNAMECALHLEKSVNQSLLELHKLATDMKAIKELGEHVTNLCKMGAPESGSAEYLLDKHTLGDSDNES

SEQ ID NO: 2340 - protein, 60 aa, Homo sapiens; identical to SEQ ID NO: 2337

SEQ ID NO: 2341 - protein, 138 aa, Homo sapiens [sequence omitted]

SEQ ID NO: 2342 - protein, 60 aa, Homo sapiens; identical to SEQ ID NO: 2337

SEQ ID NO: 2343 - protein, 136 aa, Homo sapiens
ALKNFAKYFLHQSHEEREHAEKLMKLQNQRGGRIFLQDIKKPDCDDWESGLNAMECALHLEKSVNQSLLELHKLATDKNDPHLCDFIETHYLNKQVKAIKELGEHVTNLCKMGAPESGSAEYLLDKHTLGDSDNES

SEQ ID NO: 2344 - protein, 226 aa, Homo sapiens
MTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEPF

SEQ ID NO: 2345 - protein, 226 aa, Homo sapiens; identical to SEQ ID NO: 2344

SEQ ID NO: 2346 - protein, 534 aa, Homo sapiens
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 2347 - protein, 486 aa, Homo sapiens
MTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 2348 - protein, 486 aa, Homo sapiens; identical to SEQ ID NO: 2347

SEQ ID NO: 2349 - protein, 327 aa, Homo sapiens
MLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 2350 - protein, 291 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 2351 - protein, 327 aa, Homo sapiens; identical to SEQ ID NO: 2349

SEQ ID NO: 2352 - protein, 291 aa, Homo sapiens; identical to SEQ ID NO: 2350

SEQ ID NO: 2353 - protein, 344 aa, Homo sapiens
MVLAISSCRTYSLSRRPRLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 2354 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 2355 - protein, 161 aa, Homo sapiens; identical to SEQ ID NO: 2354

SEQ ID NO: 2356 - protein, 160 aa, Homo sapiens [sequence omitted]

SEQ ID NO: 2357 - protein, 161 aa, Homo sapiens; identical to SEQ ID NO: 2354

SEQ ID NO: 2358 - protein, 338 aa, Homo sapiens [sequence omitted]

SEQ ID NO: 2359 - protein, 399 aa, Homo sapiens [sequence omitted]

SEQ ID NO: 2360 - protein, 2101 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 2361 - protein, 2101 aa, Homo sapiens; identical to SEQ ID NO: 2360

SEQ ID NO: 2362 - protein, 2124 aa, Homo sapiens [sequence omitted]

SEQ ID NO: 2363 - protein, 2110 aa, Homo sapiens [sequence omitted]

SEQ ID NO: 2364 - protein, 2128 aa, Homo sapiens [sequence omitted]

SEQ ID NO: 2365 - protein, 1536 aa, Homo sapiens [sequence omitted]

SEQ ID NO: 2366 - protein, 1536 aa, Homo sapiens [sequence omitted]

SEQ ID NO: 2367 - protein, 2115 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFQDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 2368 - protein, 667 aa, Homo sapiens
MSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVLNPVLNREVRRTGGRVLITLGDQDIDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEVTRKVEETDIVMQEVETVSQQYLPLSTACSSIYFTMESLKQIHFLYQYSLQFFLDIYHNVLYENPNLKGVTDHTQRLSIITKDLFQVAFNRVARGMLHQDHITFAMLLARIKLKGTVGEPTYDAEFQHFLRGNEIVLSAGSTPRIQGLTVEQAEAVQFGIWLDSSSPEQTVPYLWSEETPATPIGQAIHRLLLIQAFRPDRLLAMAHMFVSTNLGESFMSIMEQPLDLTHIVGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVGGQHAEDVQQHSRLTDMQVSQRACPLVLPAGLVSCDHPRTLTIRTTGVVKEV

SEQ ID NO: 2369 - protein, 463 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 2370 - protein, 463 aa, Homo sapiens [sequence omitted]

SEQ ID NO: 2371 - protein, 440 aa, Homo sapiens [sequence omitted]

SEQ ID NO: 2372 - protein, 463 aa, Homo sapiens [sequence omitted]

SEQ ID NO: 2373 - protein, 464 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 2374 - protein, 464 aa, Homo sapiens; identical to SEQ ID NO: 2373

SEQ ID NO: 2375 - protein, 462 aa, Homo sapiens [sequence omitted]

SEQ ID NO: 2376 - protein, 464 aa, Homo sapiens [sequence omitted]

SEQ ID NO: 2377 - protein, 463 aa, Homo sapiens; identical to SEQ ID NO: 2369

SEQ ID NO: 2378 - protein, 747 aa, Homo sapiens
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQASGNCHPPPPPFSFQPPATVHPALVGSAGNPFPCGVCP

SEQ ID NO: 2379 - protein, 711 aa, Homo sapiens
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQAQ

SEQ ID NO: 2380 - protein, 707 aa, Homo sapiens
MSDYSTGGPPPGPPPPAGGGGGAGGAGGGPPPGPPGAGDRGGGGPCGGGPGGGSAGGPSQPPGGGGPGIRKDAFADAVQRARQIAAKIGGDAATTGNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRNVTKAGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGIPGGRGRGRGQGNWGPGGEMTFSIPTHKCGLVIGRGGENVKAINQQTGAFVEISRQLPPTGTPTSKLFIIRGSPQQIDHCRQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPVPGPQPPPTQQGQQQQ

SEQ ID NO: 2381 - protein, 2342 aa, Homo sapiens
MPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 2382 - protein, 2684 aa, Homo sapiens [sequence omitted]

SEQ ID NO: 2383 - protein, 2677 aa, Homo sapiens [sequence omitted]

SEQ ID NO: 2384 - protein, 1805 aa, Homo sapiens
MFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 2385 - protein, 2836 aa, Homo sapiens
MQSSMNRPYICLELGAEQPASNQGQSTLQPLPPSHKQHSAQHHPSITSLNRNSLTNRRNQSPAPPAALPAELQTTPESVQLQDSWVLGSNVPLESSCVDVKERPARPLAAAARSAGSAAAGRDSGVLALLQARVWGWPLRSGLGPSTGFAGQAIGLPPGRSPSQATGGPAAGVLGGPGCSADHKNTMAMKGARPPVTWVSQGLRGGFPMALGAAAGAAVGSGTYCYVFKGKIIHLITTKRVFMGPKTKVRDYVVGHGPANLSLPEFCVFLYTQLCQNATHEAEGRLLSLGPVAPLLLPAPLRFSTCSQRGHVPLSGGKPFLPSHHFSPQSTLFHSAVWALENRHFLFKTGTGTTPLFSTATPGYTMASGSVYSPPTRPLPRNTLSRSAFKFKKSSKSVPLLYVLDLKGFLTVVVITLPSYSSSIALVNSSTYTMHLFGLNWQLQQTENDTFENGKVNSDTMPTNTVSLPSGDNVKPTDNLSVSYDHSQVQALGLYGGSDLRKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 2386 - protein, 2715 aa, Homo sapiens
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIAHYLDKIVKEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELRNKDFRHSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 2387 - protein, 351 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 2388 - protein, 330 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRVEMGFCHVGQNGFELLTSSYLPASASQSAEIIAVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 2389 - protein, 302 aa, Homo sapiens
MVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 2390 - protein, 351 aa, Homo sapiens; identical to SEQ ID NO: 2387

SEQ ID NO: 2391 - protein, 237 aa, Homo sapiens
MAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 2392 - protein, 44 aa, Homo sapiens
MAEALGVSVTDYTFEDCQLALAEGQLRLPADTCLLEFARLVRGL

SEQ ID NO: 2393 - protein, 1286 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSGWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 2394 - protein, 1259 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 2395 - protein, 693 aa, Homo sapiens [sequence omitted]

SEQ ID NO: 2396 - protein, 1348 aa, Homo sapiens [sequence omitted]

SEQ ID NO: 2397 - protein, 1341 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 2398 - protein, 847 aa, Homo sapiens
MRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 2399 - protein, 1315 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 2400 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 2401 - protein, 1278 aa, Homo sapiens; identical to SEQ ID NO: 2400

SEQ ID NO: 2402 - protein, 274 aa, Homo sapiens
MRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKVPGAPCSFHAQHTSCWTPNHVLLPASTSPGDRYLDGLVSRTEAVPSSEVACCSYLAPVPPHTSLSHLLLLTRKLGSSSLSGTQMTGLSRKGCVHEAAGVVLEGY

SEQ ID NO: 2403 - protein, 1014 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 2404 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 2405 - protein, 1070 aa, Homo sapiens; identical to SEQ ID NO: 2404

SEQ ID NO: 2406 - protein, 816 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGRPQAVPEDFQEQG

SEQ ID NO: 2407 - protein, 568 aa, Homo sapiens
MGTLDESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVACAGGVGGPWQPSPLQDDPDHWVVGGCRCGLHHCRAGPHVLLQEALQSQAAAEAARGRGARDGMPQRWAFAERAALSRDPRRSGLDQLGLRPRGHQQTPQHK

SEQ ID NO: 2408 - protein, 1070 aa, Homo sapiens [sequence omitted]

SEQ ID NO: 2409 - protein, 306 aa, Homo sapiens
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 2410 - protein, 306 aa, Homo sapiens; identical to SEQ ID NO: 2409

SEQ ID NO: 2411 - protein, 617 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 2412 - protein, 617 aa, Homo sapiens; identical to SEQ ID NO: 2411

SEQ ID NO: 2413 - protein, 327 aa, Homo sapiens [sequence omitted]

SEQ ID NO: 2414 - protein, 309 aa, Homo sapiens
  VARIANT (1)...(309): Xaa = Any Amino Acid
MINHLLLNNSAKMSILGPGTWKSPPDLVTESVNVVINIGYCHIDCAHVYQNENESGVAIXEKLREQAVKCKXLFIISNLWCTCLKKGLLKKTCQKMLSYLNLDYLDIYLIHWTTGFKPGKKFFPLDDSAIVYPNDTSIVDTXAAMKELVDEGLVKAIGISKFNYSHVRRILNKRGLKYQPMVKEIEFCTYLTQKKLIQYCQSKGIMVTAYSPLDCLDRPWAKLKDSSVLEDARSKVITVKHNKTTAQVLIXFPIQRNLVVNPKSVTQKCIAENFKAFYFELSSKDMTTLPSYNRNCALVSCTSHKDYPF

SEQ ID NO: 2415 - protein, 427 aa, Homo sapiens [sequence omitted]

SEQ ID NO: 2416 - protein, 446 aa, Homo sapiens [sequence omitted]

SEQ ID NO: 2417 - protein, 485 aa, Homo sapiens
MTLWILPKFKAVDFSPSLAAYTHTWLLPRFLEILIQCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 2418 - protein, 505 aa, Homo sapiens [sequence omitted]

SEQ ID NO: 2419 - protein, 505 aa, Homo sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 2420 - protein, 480 aa, Homo sapiens
MRLRRLALFPGVALLLAAARLAAASDFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 2421 - protein, 505 aa, Homo sapiens; identical to SEQ ID NO: 2419

SEQ ID NO: 2422 - protein, 734 aa, Homo sapiens [sequence omitted]

SEQ ID NO: 2423 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 2424 - protein, 318 aa, Homo sapiens
ATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 2425 - protein, 524 aa, Homo sapiens [sequence omitted]

SEQ ID NO: 2426 - protein, 574 aa, Homo sapiens [sequence omitted]

SEQ ID NO: 2427 - protein, 574 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 2428 - protein, 3396 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 2429 - protein, 1642 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 2430 - protein, 2409 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 2431 - protein, 3396 aa, Homo sapiens; identical to SEQ ID NO: 2428

SEQ ID NO: 2432 - protein, 2409 aa, Homo sapiens; identical to SEQ ID NO: 2430

SEQ ID NO: 2433 - protein, 1642 aa, Homo sapiens; identical to SEQ ID NO: 2429

SEQ ID NO: 2434 - protein, 655 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 2435 - protein, 3396 aa, Homo sapiens; identical to SEQ ID NO: 2428

SEQ ID NO: 2436 - protein, 606 aa, Homo sapiens [sequence omitted]

SEQ ID NO: 2437 - protein, 606 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTIGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 2438 - protein, 534 aa, Homo sapiens [sequence omitted]

SEQ ID NO: 2439 - protein, 619 aa, Homo sapiens [sequence omitted]

SEQ ID NO: 2440 - protein, 545 aa, Homo sapiens [sequence omitted]

SEQ ID NO: 2441 - protein, 82 aa, Homo sapiens
MAGALMLPPWMTMEPCCFLKGDKVWVYPPEKKEKGYPKLLQDEFPGIPSPLDAAVECHRGECQAEGVLFFQGQSRLESKNLE

SEQ ID NO: 2442 - protein, 245 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 2443 - protein, 245 aa, Homo sapiens; identical to SEQ ID NO: 2442

SEQ ID NO: 2444 - protein, 245 aa, Homo sapiens; identical to SEQ ID NO: 2442

SEQ ID NO: 2445 - protein, 650 aa, Homo sapiens
MMGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 2446 - protein, 650 aa, Homo sapiens; identical to SEQ ID NO: 2445

SEQ ID NO: 2447 - protein, 659 aa, Homo sapiens [sequence omitted]

SEQ ID NO: 2448 - protein, 659 aa, Homo sapiens [sequence omitted]

SEQ ID NO: 2449 - protein, 650 aa, Homo sapiens; identical to SEQ ID NO: 2445

SEQ ID NO: 2450 - protein, 434 aa, Homo sapiens [sequence omitted]

SEQ ID NO: 2451 - protein, 650 aa, Homo sapiens; identical to SEQ ID NO: 2445

SEQ ID NO: 2452 - protein, 466 aa, Homo sapiens [sequence omitted]

SEQ ID NO: 2453 - protein, 466 aa, Homo sapiens [sequence omitted]

SEQ ID NO: 2454 - protein, 466 aa, Homo sapiens [sequence omitted]

SEQ ID NO: 2455 - protein, 466 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGCIPTEEQVSWLSKEWAKRAALPSHVVTMLDNFPTNLHPMSQLSAAVTALNSESNFAQAYARGISRTKYWELIYEDSVDLIAKLPCVAAKIYRNLYWEGSGIGAIDSNLDWSHNFTNMLGYTDHQFTELMRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 2456 - protein, 466 aa, Homo sapiens [sequence omitted]

SEQ ID NO: 2457 - protein, 450 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 2458 - protein, 148 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAHPAGRCQLASSPQLPGILGWLFGLLALPVGRKVCWSRRADPFTQDPLRRQSLALL

SEQ ID NO: 2459 - protein, 83 aa, Homo sapiens
MREIVHLQAGQCGNQIGAKAASTCPAPCSWIWSPAPWTPCARGPSGRSSGRTTSFSVRVVLGTTGPRGTTQKARSWWTRCWML

SEQ ID NO: 2460 - protein, 450 aa, Homo sapiens; identical to SEQ ID NO: 2457

SEQ ID NO: 2461 - protein, 118 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAGHWRPRERVLWGEQKPLMHFKWNEV

SEQ ID NO: 2462 - protein, 71 aa, Homo sapiens [sequence omitted]

SEQ ID NO: 2463 - protein, 55 aa, Homo sapiens
MREIVHIQAGQCGNQIGAKFWEVISDEHGIDPSGNYVGDSDLQLERISVYYNEAS

SEQ ID NO: 2464 - protein, 164 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGKFPLLQALMADPITGKPRSVDGDGCEKQGMVSSSHDPEWWELISPFYSWALEAQRKGSVGRTETTHAFQVE

SEQ ID NO: 2465 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGIGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 2466 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVILNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGIGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 2467 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 2468 - protein, 204 aa, Homo sapiens [sequence omitted]

SEQ ID NO: 2469 - protein, 200 aa, Homo sapiens
MTEWETAAPAVAETPDIKLFGKWSTDDVQINDISLQDYIAVKEKYAKYLPHSAGRYAAKRFRKAQCPIVERLTNSMMMHGRNNGKKLMTVRIVKHAFEIIHLLTGEVLVNAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 2470 - protein, 204 aa, Homo sapiens [sequence omitted]

SEQ ID NO: 2471 - protein, 204 aa, Homo sapiens [sequence omitted]

SEQ ID NO: 2472 - protein, 368 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQVGLQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 2473 - protein, 189 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 2474 - protein, 189 aa, Homo sapiens; identical to SEQ ID NO: 2473

SEQ ID NO: 2475 - protein, 118 aa, Homo sapiens
MSGGSSCSQTPSRAIPATRRVVLGDGVQLPPGDYSTTPGGTLFSTTPGGTRIIYDRKFLMECRNSPVTKTPPRDLPTIPGVTSPSSDEPPMEASQSHLRNSPEDKRAGGEESQFEMDI

SEQ ID NO: 2476 - protein, 118 aa, Homo sapiens; identical to SEQ ID NO: 2475

SEQ ID NO: 2477 - protein, 118 aa, Homo sapiens; identical to SEQ ID NO: 2475

SEQ ID NO: 2478 - protein, 200 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 2479 - protein, 89 aa, Homo sapiens
MALLLCFVLLCGVVDFARSLSITTPEEMIEKAKGETAYLPCKFTLSPEDQGPLDIEWLISPADNQKVDQVGRCATSKEPYVHCQKLHRQ

SEQ ID NO: 2480 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 2481 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMMPAQSQAGSLV

SEQ ID NO: 2482 - protein, 2973 aa, Homo sapiens [sequence omitted]

SEQ ID NO: 2483 - protein, 2960 aa, Homo sapiens
MPGIKVGGSGVNVNAKGLDLGGRGGVQVPAVDISSSLGGRPVEVQGPSLESGDHAKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVDVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLRKADIDVSGPSVDTDAPDLDIEGPEGKLKGSKFKMPKLNIKAPKVSMPDVDLNLKGPKLKGEIDASVPELEGDLRGPQVDVKGPLVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHTLPKVEGDLKGPEADIKGPKVDINTPDVDVHGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDPKLKVPKVKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGPKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGSRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 2484 - protein, 100 aa, Homo sapiens [sequence omitted]

SEQ ID NO: 2485 - protein, 649 aa, Homo sapiens
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEARRFTRIAVDEVHCCSQWGHDFRPDYKALGILKRQFPNASLIGLTATATNHVLTDAQKILCIEKCFTFTASFNRPNLYYEVRQKPSNTEDFIEDIVKLINGRYKGQSGIIYCFSQKDSEQVTVSLQNLGIHAGAYHANLEPEDKTTVHRKWSANEIQVVVATVAFGMGIDKPDVRFVIHHSMSKSMENYYQESGRAGRDDMKADCILYYGFGDIFRISSMVVMENVGQQKLYEMVSYCQNISKCRRVLMAQHFDEVWNSEACNKMCDNCCKDSAFERKNITEYCRDLIKILKQAEELNEKLTPLKLIDSWMGKGAAKLRVAGVVAPTLPREDLEKIIAHFLIQQYLKEDYSFTAYATISYLKIGPKANLLNNEAHAITMQVTKSTQNSFRAESSQTCHSEQGDKKMEEKNSGNFQKKAANMLQQSGSKNTGAKKRKIDDA

SEQ ID NO: 2486 - protein, 649 aa, Homo sapiens; identical to SEQ ID NO: 2485

SEQ ID NO: 2487 - protein, 649 aa, Homo sapiens; identical to SEQ ID NO: 2485

SEQ ID NO: 2488 - protein, 649 aa, Homo sapiens; identical to SEQ ID NO: 2485

SEQ ID NO: 2489 - protein, 649 aa, Homo sapiens; identical to SEQ ID NO: 2485

SEQ ID NO: 2490 - protein, 649 aa, Homo sapiens; identical to SEQ ID NO: 2485

SEQ ID NO: 2491 - protein, 649 aa, Homo sapiens [sequence omitted]

SEQ ID NO: 2492 - protein, 422 aa, Homo sapiens
MRCVSLLLDADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 2493 - protein, 452 aa, Homo sapiens
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 2494 - protein, 452 aa, Homo sapiens; identical to SEQ ID NO: 2493

SEQ ID NO: 2495 - protein, 244 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 2496 - protein, 244 aa, Homo sapiens; identical to SEQ ID NO: 2495

SEQ ID NO: 2497 - protein, 252 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQGTGRWASRDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 2498 - protein, 193 aa, Homo sapiens
MELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 2499 - protein, 516 aa, Homo sapiens
QVCLLQLPMWHPQKHSPMNGLSPKKDPLMQILYVLRCIILLWIPLKIYSLGLLGQKYARKEVYMQIGDRKMTRSSICFLYLMRMRVYSWKIISECLQLHLIRWIRQMKTFRNLIKCTGLLMLNALQLADHYTGGMKQKYTVNQCRWQSEDSTFYLGERTYYIAAVEVEWDYSPQREWEKELHHLQEQNVSNAFLDKGEFYIGSKYKKVVYRQYTDCTFRIPVERKAEEEHLGILGLQLHADVGDKVKIIFKNMTTRPYSIHAHGVQTESSTFIPALPGETLTYLWKIPERSGAGTEDSACIPWAYYSTVDQVKDLYSGLIGPLIVCRRHYLKVFNPRKKLEFTLLFLVFDENESWYLDDNIKTNSDHPKKVNKDDEEFIESNKMHAVNGRMFGNPQGLTMHMGDEANGRNRLTHCTFSRPLLIQAQGCLFCLHFPWNIPNPRNVSKNTWNLVTPLPCDPHSCWNGNHLHCSTKRHQVWLNEIHWVEKREKPMIHNNVCESVKNVTLELTLKEDWKH

SEQ ID NO: 2500 - protein, 582 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 2501 - protein, 282 aa, Homo sapiens
MWSSRGTTSPGPVPGKCRWGILCATTTTALLKMARSLIQAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGRGVPQPPPQLLLRTAHCV

SEQ ID NO: 2502 - protein, 643 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 2503 - protein, 582 aa, Homo sapiens; identical to SEQ ID NO: 2500

SEQ ID NO: 2504 - protein, 582 aa, Homo sapiens; identical to SEQ ID NO: 2500

SEQ ID NO: 2505 - protein, 456 aa, Homo sapiens
MWREFIIHPLLLATVLDSGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGLSLKFHAPF

SEQ ID NO: 2506 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 2507 - protein, 655 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGK

SEQ ID NO: 2508 - protein, 819 aa, Homo sapiens; identical to SEQ ID NO: 2506

SEQ ID NO: 2509 - protein, 604 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPELI

SEQ ID NO: 2510 - protein, 747 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 2511 - protein, 604 aa, Homo sapiens; identical to SEQ ID NO: 2509

SEQ ID NO: 2512 - protein, 246 aa, Homo sapiens
VDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 2513 - protein, 247 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 2514 - protein, 83 aa, Homo sapiens [sequence omitted]

SEQ ID NO: 2515 - protein, 576 aa, Homo sapiens
TSAPSCSRHPGEEGLRAPAGDLLPSAFRVPAAFPTKVPVPGPGSGGNGPEREGPEEPGLAKQDSFRSRLNPLVQRSSRLRSSLIFSTSQAEGAAGAAAATEKVQLLHKEQTVSETLGPGGEAVRSAASTKVAELLEKYKGPARDPGGGAGAITVASHSKAVVSQAWREEVAAPGAVGGERRSLESCLLDLRDSFAQQLHQEAERQPGAASLTAAQLLDTLGRSGSDRLPSRFLSAQSHSTSPQGLDSPLPLEGSGAHQVLHNESKGSPTSAYPERKGSPTPGFSTRRGSPTTGFIEQKGSPTSAYPERRGSPVPPVPERRSSPVPPVPERRGSLTLTISGESPKAGPAEEGPSGPMEVLRKGSLRLRQLLSPKGERRMEDEGGFPVPQENGQPESPRRLSLGQGDSTEAATEERGPRARLSSATANALYSSNLRDDTKAILEQISAHGQKHRAVPAPSPGPTHNSPELGRPPAAGVLAPDMSDKDKCSAIFRSDSLGTQGRLSRTLPASAEERDRLLRRMESMRKEKRVYSRFEVFCKKEEASSPGAGEGPAEEGTRDSKVGKFVPKILGTFKSKK

SEQ ID NO: 2516 - protein, 6884 aa, Homo sapiens [sequence omitted]

SEQ ID NO: 2517 - protein, 6885 aa, Homo sapiens [sequence omitted]

SEQ ID NO: 2518 - protein, 6885 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEQDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 2519 - protein, 6883 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVARIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 2520 - protein, 6825 aa, Homo sapiens [sequence omitted]

SEQ ID NO: 2521 - protein, 2223 aa, Homo sapiens [sequence omitted]

SEQ ID NO: 2522 - protein, 977 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 2523 - protein, 1410 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGKKAEGAQNQGKKAEGAQNQGKKSEGAQNQGKKVEGAQNQGKKAEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 2524 - protein, 1474 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEVKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 2525 - protein, 1474 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 2526 - protein, 163 aa, Homo sapiens
WTFTFCCRVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRAAKEAKKAKQASKKTAMAAAKAPTKAAPKQKIVKPVKVSAPRVGGKR

SEQ ID NO: 2527 - protein, 150 aa, Homo sapiens
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRAAKEAKKAKQASKKTAMAAAKVIMGFLYFLEQYNRKIFFF

SEQ ID NO: 2528 - protein, 157 aa, Homo sapiens [sequence omitted]

SEQ ID NO: 2529 - protein, 168 aa, Homo sapiens
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRAAKEAKKAKQASKKTAMAAAKLLLGASKGLTQRLQTLRWRSVLGRVCSWSPRPEMFWL

SEQ ID NO: 2530 - protein, 110 aa, Homo sapiens
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIR

SEQ ID NO: 2531 - protein, 157 aa, Homo sapiens [sequence omitted]

SEQ ID NO: 2532 - protein, 184 aa, Homo sapiens [sequence omitted]

SEQ ID NO: 2533 - protein, 125 aa, Homo sapiens
MGLAGVCALRRSAGYILVGGAGGQSAAAAARRCSEGEWASGGVRSFSRAAAAMAPIKVRLLADPTGAFGKETDLLLDDSLVSIFGNRRLKRFSMVVQDGIVKALNVEPDGTGLTCSLAPNIISQL

SEQ ID NO: 2534 - protein, 67 aa, Homo sapiens [sequence omitted]

SEQ ID NO: 2535 - protein, 72 aa, Homo sapiens
MAKISGPTETARCIESLIAVFQKYAGKDGYNCNLSKTEFPSFMNKELAAFTKNQKDPGVLDRMKKLAVSSDG

SEQ ID NO: 2536 - protein, 102 aa, Homo sapiens [sequence omitted]

SEQ ID NO: 2537 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 2538 - protein, 102 aa, Homo sapiens
MAKISSPTETERCIESLIAVFQKYAGKDGYNRNLSKTEFLSFMNTELAAFTKNQKDPGVLDHMKKLDVSSDGQLDFPKFLNLIGGLAVACHDSFLKAVPSQK

SEQ ID NO: 2539 - protein, 105 aa, Homo sapiens; identical to SEQ ID NO: 2537

SEQ ID NO: 2540 - protein, 843 aa, Homo sapiens [sequence omitted]

SEQ ID NO: 2541 - protein, 843 aa, Homo sapiens
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGPMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 2542 - protein, 843 aa, Homo sapiens [sequence omitted]

SEQ ID NO: 2543 - protein, 177 aa, Homo sapiens [sequence omitted]

SEQ ID NO: 2544 - protein, 364 aa, Homo sapiens [sequence omitted]

SEQ ID NO: 2545 - protein, 241 aa, Homo sapiens [sequence omitted]

SEQ ID NO: 2546 - protein, 227 aa, Homo sapiens [sequence omitted]

SEQ ID NO: 2547 - protein, 230 aa, Homo sapiens [sequence omitted]

SEQ ID NO: 2548 - protein, 359 aa, Homo sapiens
MRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 2549 - protein, 364 aa, Homo sapiens [sequence omitted]

SEQ ID NO: 2550 - protein, 227 aa, Homo sapiens
MYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 2551 - protein, 394 aa, Homo sapiens [sequence omitted]

SEQ ID NO: 2552 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 2553 - protein, 196 aa, Homo sapiens; identical to SEQ ID NO: 2552

SEQ ID NO: 2554 - protein, 890 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 2555 - protein, 896 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 2556 - protein, 896 aa, Homo sapiens; identical to SEQ ID NO: 2555

SEQ ID NO: 2557 - protein, 865 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 2558 - protein, 344 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 2559 - protein, 188 aa, Homo sapiens
QLVDQSLRLLGDTSLPKPAAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 2560 - protein, 344 aa, Homo sapiens; identical to SEQ ID NO: 2558

SEQ ID NO: 2561 - protein, 1022 aa, Homo sapiens
MNNNWNVCFFLFCPSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 2562 - protein, 1081 aa, Homo sapiens
MVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 2563 - protein, 1041 aa, Homo sapiens
MNNNWNVCFFLFCPSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 2564 - protein, 1175 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 2565 - protein, 1062 aa, Homo sapiens
MVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 2566 - protein, 1194 aa, Homo sapiens
MAKPYEFNWQKEVPSFLQEGTVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 2567 - protein, 406 aa, Homo sapiens
MTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKASDDLEHENNKK

SEQ ID NO: 2568 - protein, 1175 aa, Homo sapiens
MAKPYEFNWQKEVPSFLQEGTVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 2569 - protein, 238 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 2570 - protein, 238 aa, Homo sapiens; identical to SEQ ID NO: 2569

SEQ ID NO: 2571 - protein, 275 aa, Homo sapiens
MLGGVTLKLFYLLPRTAASGARSRPEPGTQVRSLNFRMLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 2572 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 2573 - protein, 241 aa, Homo sapiens [sequence omitted]

SEQ ID NO: 2574 - protein, 583 aa, Homo sapiens [sequence omitted]

SEQ ID NO: 2575 - protein, 1234 aa, Homo sapiens [sequence omitted]

SEQ ID NO: 2576 - protein, 168 aa, Homo sapiens [sequence omitted]

SEQ ID NO: 2577 - protein, 1207 aa, Homo sapiens [sequence omitted]

SEQ ID NO: 2578 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 2579 - protein, 986 aa, Homo sapiens
CWGRAMVGPLMALFLWRTLESTFPALKCSTRRRKRSQQAAAASASAASCPYLSWRRRDPPPWAPESCDPHNGVATLGFLATPSESYDCGRGFGGPRRGALAAVCAAGARRRVRARRLRRAGPGVRRHRRGQRRRGNLPTSSKLPRALSFSDIGLSLAEFWCLFAYFKSGNRWWADNRRHALPHALCTRELFPRIRVVVDERSEEESQYYTHWVAMVIPWMAGKRFRLALCQSSADCLLCRDLDCGRQALPFGHLYWNLEEVICQLYDIKKNAELSRSPASENHSKSLGVHLCIHAPCRTLQGGCYRGSLSWNPFSKRCKVDWEEALVFRLHFKHGCRLLGSHFKSELYQWLYDFHNRMEFSGLLTVALWEMRVDDGPRAMEWALRGRISCLGISSYHSVYSTWLVLPEDSWPFRERRKLRSSDWLREPHHHHNHESTFVHTAISSLFQCVTTICHLCSGIFNTRATGMVYQTWKNIRKISFAAGFSMAPQRWQFHTEPARAVHTHHSHHWSQRQLPASSKIPALPKYLGFQCLPIFSSKLCSNWCIIFYKYRPWRASLHATPSSQPETHYVGCRCIQHNQYYRRLQLDQSDYKVCLHRDPHRRCVHCRKSKRWYFDKCQRNFLLDFCKWILQGYRFSWMDYICFRTCSYSKKMVYTHVNYGSFRLWHAEQVSVDRHPCEFSKEWLGCNWNSLLICTVQLSCGSHTLILNRASNTLDFLPFFLVLVQSQFLFHWNSIGFDKRVKGERNLFLIYPVEDFIRINSKGKTVAIPLGVVVVQTSKPCCHGSSLHLICKRSCRWQLDHHDVFMHADRVSKASVFITRCCHNRKLKNTRSSFLKTTSTCYALCSKKYFFIFLFKMILLKCRIVGFKCLFNKLPLTLFLRILADLGYLHYLIFLIPSFGLVTTITLCERFSRWLEEGRKPDIANAVVVVSSASSHCAVVCPHMCTGNRLTQLMNAFLSLCVEGGEHLDICLPELDHLLRCTYFL

SEQ ID NO: 2580 - protein, 323 aa, Homo sapiens; identical to SEQ ID NO: 2572

SEQ ID NO: 2581 - protein, 737 aa, Homo sapiens [sequence omitted]

SEQ ID NO: 2582 - protein, 2671 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 2583 - protein, 2671 aa, Homo sapiens [sequence omitted]

SEQ ID NO: 2584 - protein, 104 aa, Homo sapiens
MAKISSPTETVRCIQSLIAVFQKYAGKDGYNCNLSKTEFLSFMNTELAAFTKNQKDPGVLDRMKKLDVSSDGQLDFPKFLNLIGGLAVACHDSFLKAVPSQKWT

SEQ ID NO: 2585 - protein, 125 aa, Homo sapiens
MAKISSPTETVRCIQSLIAVFQKYAGKDGYNCNLSKTEFLSFMNTELAAFTKNQKDPGVLDRMKKLDVSSDGQLDFPKFLNLIGGLAVACHDSFLKAVPSQKWTGPLGPGLQTHPLSFQPFCHHL

SEQ ID NO: 2586 - protein, 191 aa, Homo sapiens
MQTIKCVFVGNGAVGKTCLLISYTTNKFPSKYVPTVFDNYAVTVMIGGETYTLGLFDTAGQDDDDRLPLSYLQTDVFPVCFSVVSPSSFENVKGKWVSKITHHCPKTHFLLVGTLIHLRDDPSTIEKLAKNKQKPTTPETAEKLIRDLKAVRYVVCSALTQKGLRNVFDEAILASLEPPELKKSHRCVLLG

SEQ ID NO: 2587 - protein, 191 aa, Homo sapiens
MQTIKCVVVGDGAVSKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKPAKNKQKPITPETAEKLARDLKAVKYVECSALTKKGLKNVFDEAILAALEPPEPKKSRRCVLL

SEQ ID NO: 2588 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 2589 - protein, 191 aa, Homo sapiens; identical to SEQ ID NO: 2587

SEQ ID NO: 2590 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 2591 - protein, 191 aa, Homo sapiens; identical to SEQ ID NO: 2590

SEQ ID NO: 2592 - protein, 191 aa, Homo sapiens; identical to SEQ ID NO: 2590

SEQ ID NO: 2593 - protein, 191 aa, Homo sapiens; identical to SEQ ID NO: 2588

SEQ ID NO: 2594 - protein, 191 aa, Homo sapiens; identical to SEQ ID NO: 2588

SEQ ID NO: 2595 - protein, 191 aa, Homo sapiens; identical to SEQ ID NO: 2590

SEQ ID NO: 2596 - protein, 191 aa, Homo sapiens; identical to SEQ ID NO: 2588

SEQ ID NO: 2597 - protein, 191 aa, Homo sapiens; identical to SEQ ID NO: 2587

SEQ ID NO: 2598 - protein, 191 aa, Homo sapiens; identical to SEQ ID NO: 2588

SEQ ID NO: 2599 - protein, 416 aa, Homo sapiens
LFLSVPYTRVGRGESGLKMEVKPPPSRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKTLSKQEMQSAGSRRGRGGGSGNFMGRGGNFGGGGGGGSRGSYGGGDGGYNGFGGDGGNYGGGPGYSSRGGYGDGGPGYGNQGGGYGGGGGYDGYNEGGNFGGGNYGGGGNYNDFGNYSGQQQSNYGPMKGGSFGGRSSGGPYGGGYGSGGGSGGYGSRRFKQQKRVEEPYLPKGMSFLPSKIRRFLAGGLLTVKPDDT

SEQ ID NO: 2600 - protein, 319 aa, Homo sapiens
MKPIKKYIGKDVDTLGASKENDLDIKELKKVLGKINEALQKCLVVEPKRAVSREDSVKPVAHLTVKKIFVGGIKEDTEEYNLRDYFEKCSKIETIEVMEDRQSGKKRGFAFVTFDDHDIIDKIVVQKYHTINGHNCEVKKALSKQEMQSAGSQRGHGGGSGNFMGRGGNFGGAGGNFGLGGNFGGRGGYGGGGGGSRGSYGRGDGGYNRFGRDGGNYGGGPGYSSRGGYGGGGTGYGNQGGGYGGGGGGYDGYNEGGNFGGGNYGGGGNYNDFGNHSGQQQSNYGPMKGGSFGGRSSGSPYGGGYGSGGGSGGYGSRRF

SEQ ID NO: 2601 - protein, 356 aa, Homo sapiens
MEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 2602 - protein, 1060 aa, Homo sapiens [sequence omitted]

SEQ ID NO: 2603 - protein, 378 aa, Homo sapiens
MEVKPPPGRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 2604 - protein, 404 aa, Homo sapiens
CLVVEPKRAVSREDSVKPVAHLTVKKIFVGGIKEDTEEYNLRDYFEKCSKIETIEVMEDRQSGKKRGFAFVTFDDHDIIDKIVVQKYHTINGHNCEVKKALSKQEMQSAGSQRGHGGGSGNFMGRGGNFGGAGGNFGLGGNFGGRGGYGGGGGGSRGSYGRGDGGYNRFGRDGGNYGGGPGYSSRGGYGGGGTGYGNQGGGYGGGGGGYDGYNEGGNFGGGNYGGGGNYNDFGNHSGQQQSNYGPMKGGSFGGRSSGSPYGGGYGSGGGSGGYGSRRFKQQKRATVLSRRESKELSGKLQVTSRELSQMHRNCKNLPQKEQSIVRKFTAATGNPSCSGLSPQFAKSAAIDCNIVSTRCRFLRSFICCSFVFFFFFSLHQVYCPVNCGSGTRNKKLRNFLFKKKK

SEQ ID NO: 2605 - protein, 456 aa, Homo sapiens
IELELEEASLVSKWRAMIQRNQRSENCLLVVALKLQMIVENILRNGAHSQIVWETPKQNVPGALVLLILVLKRWMQQCVLDHTRLMGVWNQRQLFLERILSLVPIQRKFLLVVLKKIQKNIIETSLKSMAKLKPKLRKTGRVGKRGFAFVTFDEHDTVDKIVVQKYHTINGHNCEVKKALSKQEMQSAGSQRGRGGGSGNFMGRGGNFGGGGGAMVVEVVAAEVVMEEVMVDIMDLEVMVATMVWSWLRGLWWWWTRIWKPRWWIWWRWWRIWLQRRKFWRWLWWWWELFWKLWTTAIKLWTRERGQFWWKKLGQSLWWWLWIWWWKWWIWQKVRKTAEKGYSSERERGVVRKTAAYFETVLPNALEELKSATEGTMIHSQKSYCSLNRKPFLFRTVIATVCKKCSYLIQCSVNMYIPEVFYLLLCLFLFLFITSSILPCKLWWYQEKIKEFLTFQ

SEQ ID NO: 2606 - protein, 612 aa, Homo sapiens
RLKMEVKPPPGRPQSDSSRRHCHRQEEGHDPKEPEQLRKLFIGSLNFETTDDSLRGHFEKWGTLTDCVVMRDPQTKWSRGFGFVTYSCVEEVDAAMCAPHKVDGHVVEPKRAVSREDSVKPGAHLTVKKIFVGGITEDTKEYNLRDYFEKYGKIETIEVMQERQSGKKRGSAFVTFDDHDTVDKIVVQKYHTINGHNCEVKKALSKQEMQSAGSRTGRGGGSGNFMGCGGSFGGGGGNFGRGGNFGGRGGYGGGGGGSRGSYGGGDGGYNGFGSDGGNYAGGPGYSSRGGYGGGGPGYGNQGGVVDMVAVVEDMMVTMKEEILAVVTMVVVGTIMILEIIVDNSNQIMDPKGEVLVEEARAVPMVVVMHLVVEVVDIVAEGSKNSRKGLQFSAGESARSCQESCRLLDSRPKCIRGTVKICHRRKDDPSEKLLQLKQETLLVQDYHSHSLQEVQLLINAMCQLDVHSGFLSVVALSFSFSFHYIRYIALIVVVVPGIKNGIFNFSIFMFSFSTFYRNFNKMQFRCFLVSQVKIIVNYYFVILLKLTVKKHLLTCSLRGIYSPHFQTTIMGTDVERIDNLCVCNVCFRIGLNIISICEFNSITITFKKKSQNF

SEQ ID NO: 2607 - protein, 378 aa, Homo sapiens; identical to SEQ ID NO: 2603

SEQ ID NO: 2608 - protein, 596 aa, Homo sapiens
KRVRSQNGGKTDAQWPQAQFQLPSPPGAEDHDPKEPELGKLFIGVLSFETTDDSLREHLEKWAHSQIVWDTPKENVPGGLVLLTLVLKRWMQQHVLNHTGWWVSIGTKDNSFRGVDKACPSTSEEKFPWWYRRYRRIFETTLKSMARLKPWKLWKTDRVKKRKDLLLQLLMITIQLITLLFRNTTVDNIVIQKYHTINGHNCEVKRPFLNKRCSLLDHREIVEVDLAILWVAEETFEVVEVILAMVATLVEEEAMLVEVVAAEIVMKEVMVDIMDLEATVATMTVVLVIVVEGAMVVADQDMETKVVDMVVVVEDMMVAMEEIWWWLWWWWELFWKLWTTAIKLRTHVRGQFWWKKLIPMMVVMDLVMDMVDIGAEGFENSRKGLQLLAGEREKLLGKLEVTLRQSSQMHRNFKNLPEGTMIHSQKSYCSLNRKPSCSGLPPFAKSSAIDCDVVSITCILLRSFICGSFFFFFFFSFHQVYCPVNCGGGNRNKKLRNFLFNICVVQFFYILVQKLTKCSFEGVSLVNKIIVNYYFVILLKLTVKKHLLTCNVRGIYSPHFQTMTMGADVWTEIFVCLQCVFINRIGYLNHLIHDYL

SEQ ID NO: 2609 - protein, 356 aa, Homo sapiens; identical to SEQ ID NO: 2601

SEQ ID NO: 2610 - protein, 361 aa, Homo sapiens
RQGEEHHDPKEPQLRKLFTGGLSFETTNDSLREHFEKWGTLTDCVVMRDPQTKRSRGFVFVTYSYVEEVDAAMCARPHKVDRCVVEPKRAVSREDSVNPGLHLGVKKLFVGGIKEDTEEYNLRDYFEKYGKIETIEIMEDRQSGKKRGFAFVTFDDHDRVDKIDVQKYHTINGHNCEVKNRGGDFLNKRCSLLDHREVMEVDLVILWVMEETLEVVKVILAVMEALVEEEVMVVEVVVAEVVMEEMMVDRMDLEVMVAAMAVVLVLVVDGAMVVVDQDMQTKVVDIVAVVEDKMVTMKEKFLAVITMVVLGTIMILEIIVDNSNQTMEPKGAVLVEEAWAVRMVVVMDLVVEVVDMVAEGS

SEQ ID NO: 2611 - protein, 378 aa, Homo sapiens; identical to SEQ ID NO: 2603

SEQ ID NO: 2612 - protein, 3695 aa, Homo sapiens [sequence omitted]

SEQ ID NO: 2613 - protein, 3714 aa, Homo sapiens [sequence omitted]

SEQ ID NO: 2614 - protein, 3690 aa, Homo sapiens [sequence omitted]

SEQ ID NO: 2615 - protein, 3695 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIQGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAMRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 2616 - protein, 3695 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 2617 - protein, 729 aa, Homo sapiens
AAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 2618 - protein, 691 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 2619 - protein, 691 aa, Homo sapiens
MAAGVEAAAEVAATEIKMEEESGAPGVPSGNGASGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGECARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGPSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 2620 - protein, 730 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 2621 - protein, 137 aa, Homo sapiens
EGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGR

SEQ ID NO: 2622 - protein, 515 aa, Homo sapiens [sequence omitted]

SEQ ID NO: 2623 - protein, 515 aa, Homo sapiens
MGRRGSAPGNGRTLRGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 2624 - protein, 515 aa, Homo sapiens [sequence omitted]

SEQ ID NO: 2625 - protein, 137 aa, Homo sapiens; identical to SEQ ID NO: 2621

SEQ ID NO: 2626 - protein, 515 aa, Homo sapiens
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMDALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 2627 - protein, 545 aa, Homo sapiens
MGRRGSAPGNGRTLRGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 2628 - protein, 514 aa, Homo sapiens
AEQVALSRTHVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 2629 - protein, 585 aa, Homo sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 2630 - protein, 608 aa, Homo sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 2631 - protein, 608 aa, Homo sapiens; identical to SEQ ID NO: 2630

SEQ ID NO: 2632 - protein, 231 aa, Homo sapiens
MLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 2633 - protein, 329 aa, Homo sapiens
MTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 2634 - protein, 269 aa, Homo sapiens
MTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 2635 - protein, 329 aa, Homo sapiens; identical to SEQ ID NO: 2633

SEQ ID NO: 2636 - protein, 101 aa, Homo sapiens [sequence omitted]

SEQ ID NO: 2637 - protein, 381 aa, Homo sapiens [sequence omitted]

SEQ ID NO: 2638 - protein, 381 aa, Homo sapiens [sequence omitted]

SEQ ID NO: 2639 - protein, 381 aa, Homo sapiens [sequence omitted]

SEQ ID NO: 2640 - protein, 590 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEYPLLENSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 2641 - protein, 558 aa, Homo sapiens
MVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNGDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 2642 - protein, 557 aa, Homo sapiens
MVKMAAAGGGGGGGRYYGGGSEGGRAPKRLKTDNAGDQHGGGGGGGGGAGAAGGGGGGNYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 2643 - protein, 589 aa, Homo sapiens
MSRRLLPRAEKRRRRLEQRQQPDEQRRRSGAMVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 2644 - protein, 589 aa, Homo sapiens; identical to SEQ ID NO: 2643

SEQ ID NO: 2645 - protein, 676 aa, Homo sapiens
EKRRRRLEQRQQPEEQQRRSGAMKMAAGGGRGGGGGYGGGSEGGGAPKLLKTGNAGDQHGGGGGGGGGGGGGAAGAAAGRTTMTCTKPLPPQLSTAGALTMWWKLTLWRPCRSLDPSAMRWCLKRDKHWWSLKMCWGLATPATQPTTKYTLPVTQLLSTTLPARRSPSPGTRMTPGATVCFSLPSTPFIRSPRMFFTLSVILVALSRELSFSGRMEFRRWWNLTLFKVPSGPRPLSMGLVSILAVALRWNTQSLHAMCSRMIRILGTTQTPISVDKVTLAATPTNARGSPLSWEITPQNMEGPTVGTTAITMMRATGPPDLTTKGEGWVHQSGVTVGAQVATAPQYGHPPPPPPPPEYGPHADSPVLVVGLHQSKMNCDLVFNVFCLYGNVEKVKFLKSKPGAPWWRWLMATLWTGSLPTSTTTSCLGRSMSVSPSSQPSCPVSHTGWKMGLAVTKTSVNPGTIGSPPQSRQPRTASSTPATCCTSSTPRWRRPRRTSLRSMMSWESGHLLKYSQAKASAAPLDCWNGNPRAMPWRLRASTITKTQWSIPLHSEVVFLHRSARLLIRCLGRVPSEQEGISLSFMPFFGFCFCYLQKILYSFFFFFFFCVRRGLTLTETLEVCRGRERGTDISQDPSLKNYCTCDFFFLFIHLCCPSTPGTFQNCLENKHSTCWEKK

SEQ ID NO: 2646 - protein, 456 aa, Homo sapiens
MPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNCDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 2647 - protein, 329 aa, Homo sapiens
MGRRGSAPGNGRTLRGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKGCPSSCAAARP

SEQ ID NO: 2648 - protein, 193 aa, Homo sapiens [sequence omitted]

SEQ ID NO: 2649 - protein, 261 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 2650 - protein, 261 aa, Homo sapiens; identical to SEQ ID NO: 2649

SEQ ID NO: 2651 - protein, 261 aa, Homo sapiens; identical to SEQ ID NO: 2649

SEQ ID NO: 2652 - protein, 261 aa, Homo sapiens; identical to SEQ ID NO: 2649

SEQ ID NO: 2653 - protein, 1545 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 2654 - protein, 1545 aa, Homo sapiens; identical to SEQ ID NO: 2653

SEQ ID NO: 2655 - protein, 1545 aa, Homo sapiens; identical to SEQ ID NO: 2653

SEQ ID NO: 2656 - protein, 560 aa, Homo sapiens [sequence omitted]

SEQ ID NO: 2657 - protein, 560 aa, Homo sapiens [sequence omitted]

SEQ ID NO: 2658 - protein, 559 aa, Homo sapiens
MNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 2659 - protein, 559 aa, Homo sapiens; identical to SEQ ID NO: 2658

SEQ ID NO: 2660 - protein, 720 aa, Homo sapiens
MAQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 2661 - protein, 307 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 2662 - protein, 307 aa, Homo sapiens; identical to SEQ ID NO: 2661

SEQ ID NO: 2663 - protein, 120 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVAVPGFCTPNLGDLGPGLS

SEQ ID NO: 2664 - protein, 308 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGPLPPPTLLALAPL

SEQ ID NO: 2665 - protein, 307 aa, Homo sapiens; identical to SEQ ID NO: 2661

SEQ ID NO: 2666 - protein, 366 aa, Homo sapiens [sequence omitted]

SEQ ID NO: 2667 - protein, 367 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 2668 - protein, 367 aa, Homo sapiens; identical to SEQ ID NO: 2667

SEQ ID NO: 2669 - protein, 713 aa, Homo sapiens [sequence omitted]

SEQ ID NO: 2670 - protein, 710 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 2671 - protein, 713 aa, Homo sapiens [sequence omitted]

SEQ ID NO: 2672 - protein, 710 aa, Homo sapiens; identical to SEQ ID NO: 2670

SEQ ID NO: 2673 - protein, 713 aa, Homo sapiens [sequence omitted]

SEQ ID NO: 2674 - protein, 714 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 2675 - protein, 1159 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRRRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 2676 - protein, 291 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWASN

SEQ ID NO: 2677 - protein, 1159 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 2678 - protein, 472 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNGNY

SEQ ID NO: 2679 - protein, 1159 aa, Homo sapiens; identical to SEQ ID NO: 2677

SEQ ID NO: 2680 - protein, 505 aa, Homo sapiens
MSYPGYPPPPGGYPPAAPGGGPWGGAAYPPPPSMPPIGLDNVATYAGQFNQDYLSGMAANMSGTFGGANMPNLYPGAPGAGYPPVPPGGFGQPPSAQQPVPPYGMYPPPGGNPPSRMPSYPPYPGAPVPGQPMPPPGQQPPGAYPGQPPVTYPGQPPVPLPGQQQPVPSYPGYPGSGTVTPAVPPTQFGSRGTITDAPGFDPLRDAEVLRKAMKGFGTDEQAIIDCLGSRSNKQRQQILLSFKTAYGKDLIKDLKSELSGNFEKTILALMKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 2681 - protein, 236 aa, Homo sapiens
MKTPVLFDIYEIKEAIKGVGTDEACLIEILASRSNEHIRELNRAYKAEFKKTLEEAIRSDTSGHFQRLLISLSQGNRDESTNVDMSLAQRDAQELYAAGENRLGTDESKFNAVLCSRSRAHLVAVFNEYQRMTGRDIEKSICREMSGDLEEGMLAVVKCLKNTPAFFAERLNKAMRGAGTKDRTLIRIMVSRSETDLLDIRSEYKRMYGKSLYHDISGDTSGDYRKILLKICGGND

SEQ ID NO: 2682 - protein, 505 aa, Homo sapiens; identical to SEQ ID NO: 2680

SEQ ID NO: 2683 - protein, 505 aa, Homo sapiens; identical to SEQ ID NO: 2680

SEQ ID NO: 2684 - protein, 505 aa, Homo sapiens; identical to SEQ ID NO: 2680

SEQ ID NO: 2685 - protein, 505 aa, Homo sapiens; identical to SEQ ID NO: 2680

SEQ ID NO: 2686 - protein, 505 aa, Homo sapiens; identical to SEQ ID NO: 2680

SEQ ID NO: 2687 - protein, 505 aa, Homo sapiens; identical to SEQ ID NO: 2680

SEQ ID NO: 2688 - protein, 384 aa, Homo sapiens
MTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 2689 - protein, 763 aa, Homo sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 2690 - protein, 157 aa, Homo sapiens [sequence omitted]

SEQ ID NO: 2691 - protein, 397 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 2692 - protein, 440 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 2693 - protein, 294 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKR

SEQ ID NO: 2694 - protein, 251 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKESVELPLTHPEYYEEMGIKPPKGVILYGPPGTGKTLLAKAVANQTSATFLRVVGSELIQKYLGDGPKLVRELFRVAEEHAPSIVFIDEIDAIGTKR

SEQ ID NO: 2695 - protein, 440 aa, Homo sapiens; identical to SEQ ID NO: 2692

SEQ ID NO: 2696 - protein, 319 aa, Homo sapiens
AQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 2697 - protein, 22 aa, Homo sapiens
KAWGDTSGDYKKALLLLCGEDD

SEQ ID NO: 2698 - protein, 293 aa, Homo sapiens
MKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 2699 - protein, 55 aa, Homo sapiens
MAQVLRGTVTDFPGFDERADAETLRKAMKGLDIWFQGDTSGDYKKALLLLCGEDD

SEQ ID NO: 2700 - protein, 320 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 2701 - protein, 162 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 2702 - protein, 47 aa, Homo sapiens
MPFVKTCLMVLPSVQTIWKSVTDVIIAPLCTSVGRCFSSVSLQLSQD

SEQ ID NO: 2703 - protein, 162 aa, Homo sapiens; identical to SEQ ID NO: 2701

SEQ ID NO: 2704 - protein, 134 aa, Homo sapiens [sequence omitted]

SEQ ID NO: 2705 - protein, 162 aa, Homo sapiens; identical to SEQ ID NO: 2701

SEQ ID NO: 2706 - protein, 368 aa, Homo sapiens
WMMISPRSSSTTAPACARPASRATMPPGQSSPPSLGTPGTRAWWAWVRRIPMWATRPRAREASSPSTPLSTALSPTGTTWRRSGTTPSTMSCAWLPRSNPCCCLRPPTPGPTARRPRSYLRPSTPQPCTWPSRLCCPCTPLAVPLASCWTPVMGSPTLCPSTRGMPSPTPSCFWTWLAGTLPHEDPHRAPLQLHHHAEREIMRNIKEKLCYLVLDFEQEMATAASSSSLEKSYQLPNSQVITIGNEWFCCPEALFQPSFLGMESCGIHETTFNSIMKCDLDIRKDLYTSTVLSGGTTMYPGIADRMQKEITALAPSRTKIKIIAPPERKYSVWIGGSILASLSTFQQMWISKQEYEESGPPSFTANAS

SEQ ID NO: 2707 - protein, 253 aa, Homo sapiens
MFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 2708 - protein, 845 aa, Homo sapiens [sequence omitted]

SEQ ID NO: 2709 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 2710 - protein, 375 aa, Homo sapiens; identical to SEQ ID NO: 2709

SEQ ID NO: 2711 - protein, 375 aa, Homo sapiens; identical to SEQ ID NO: 2709

SEQ ID NO: 2712 - protein, 375 aa, Homo sapiens
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 2713 - protein, 393 aa, Homo sapiens [sequence omitted]

SEQ ID NO: 2714 - protein, 556 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGKLQA

SEQ ID NO: 2715 - protein, 615 aa, Homo sapiens
MAHVRGLQLPGCLALAALCSLVHSQHARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 2716 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 2717 - protein, 622 aa, Homo sapiens; identical to SEQ ID NO: 2716

SEQ ID NO: 2718 - protein, 510 aa, Homo sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 2719 - protein, 510 aa, Homo sapiens; identical to SEQ ID NO: 2718

SEQ ID NO: 2720 - protein, 370 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2721 - protein, 350 aa, Homo sapiens
MLLLRRSLSLNVLRKEVDRACFGEKAKQIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2722 - protein, 380 aa, Homo sapiens
MKLLARALRLCEFGRQASSRRLVAGQGCVGPRRGCCAPVQVVGPRADLPPCGACITGRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2723 - protein, 338 aa, Homo sapiens
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2724 - protein, 329 aa, Homo sapiens
MAFQLSRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 2725 - protein, 380 aa, Homo sapiens; identical to SEQ ID NO: 2722

SEQ ID NO: 2726 - protein, 329 aa, Homo sapiens; identical to SEQ ID NO: 2724

SEQ ID NO: 2727 - protein, 350 aa, Homo sapiens; identical to SEQ ID NO: 2721

SEQ ID NO: 2728 - protein, 1230 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 2729 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGAPGPKGWKGDAGECRCTEGDEAIKGLPGLPGPKGFAGINGEPGRKGDKGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 2730 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 2731 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDKGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIAGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAIQPGTVGPQGRRGPPGAPGEIGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 2732 - protein, 1712 aa, Homo sapiens; identical to SEQ ID NO: 2730

SEQ ID NO: 2733 - protein, 63 aa, Homo sapiens
PCAPVPQKRDIPDYLCGKISFELMREPCITPSGITYDRKDIEEHLQVRPAAGGAGPVAWSWAP

SEQ ID NO: 2734 - protein, 303 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 2735 - protein, 303 aa, Homo sapiens; identical to SEQ ID NO: 2734

SEQ ID NO: 2736 - protein, 231 aa, Homo sapiens
MQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 2737 - DNA, 3862 bp, Homo sapiens
cggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataa

SEQ ID NO: 2738 - DNA, 3862 bp, Homo sapiens; identical to SEQ ID NO: 2737

SEQ ID NO: 2739 - DNA, 3614 bp, Homo sapiens
gtccgccaaaacctgcgcggatagggaagaacagcaccccggcgccgattgccgtaccaaacaagcctaacgtccgctgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattcatcagatccaaccacagcagttggttttgcgattaagatcaggggagccacagacatttacattaaaattcaagagagctgaagactatcccattgacctctactaccttatggacctgtcttattcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccaccccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttca

SEQ ID NO: 2740 - DNA, 3670 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggatgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 2741 - DNA, 2533 bp, Homo sapiens
gagccagcccagccgcgttccgaacgcgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatga

SEQ ID NO: 2742 - DNA, 3670 bp, Homo sapiens; identical to SEQ ID NO: 2740

SEQ ID NO: 2743 - DNA, 3876 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 2744 - DNA, 3762 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggctt

SEQ ID NO: 2745 - DNA, 3733 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 2746 - DNA, 3876 bp, Homo sapiens; identical to SEQ ID NO: 2743

SEQ ID NO: 2747 - DNA, 2481 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagta

SEQ ID NO: 2748 - DNA, 1681 bp, Homo sapiens
aaatagcactgtaaaaagtgaactgttaaaactaaaggcacttaaaacaagaatgtgactagtgtgaaacaagatgggcaactcaaatggtgagaagtaaacatacagtggtctgttatggcactaactcaaagtaagactcgcgtaggtgagagctgttgcatagccacagtataacttcacatgttcattaaaaaggcaaattgaccgctaaaacttcaaagaaaaagtactcataaaaaaagtcttaccccaaaattgcaaacaaatacattaaaagattagaagaggtgacagaaagcaccagacattaaacaaaataaaaataataaaataaattcaactcaaaaggtccccattcagcaacagaaaattgctcggttcttttatctaaggcttgaatttgtaaagtgaaggcataaaagttaccaaacattaagtaactcttaaaatggcacacaggttttaaagctattggtttttccttcctaactctctgaatttttcccatggcctttgtagatcaactatttcaaacgtattttacaccagcaactctcaacatacttgtctttcagatatgtcatcagtcatgtctaacaggcaaatagcaaaataacagatttaaaacaatccttaactagctagcaggacatttactttggattctgcataactgcaaactgacatatttgtaaagctaaaaatcagttttaatacatgattaacagaaactctcatcatgctcattactttaactattgccctttcaatcgctatagaaatatcacttaatccaataagcttgatttcaatagtccaggaagaaaaggtcaaaaaggcacaatgtgaccttagctgacaagaataaccatcctgtctcaagtcttttgtcagtccctggcatgaattacaacattattttcaaaataataaaacattttaaaaattatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcaagtccaggagttttagac

SEQ ID NO: 2749 - DNA, 2498 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagta

SEQ ID NO: 2750 - DNA, 3733 bp, Homo sapiens; identical to SEQ ID NO: 2745

SEQ ID NO: 2751 - DNA, 3670 bp, Homo sapiens; identical to SEQ ID NO: 2740

SEQ ID NO: 2752 - DNA, 3894 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 2753 - DNA, 3670 bp, Homo sapiens; identical to SEQ ID NO: 2740

SEQ ID NO: 2754 - DNA, 3670 bp, Homo sapiens; identical to SEQ ID NO: 2740

SEQ ID NO: 2755 - DNA, 3399 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttcatgtggccgatatttttatttctttaatgattttgatcctaaatctgccttttcatctaatgtgaagtagaatcctaaataatgttatctgtgtagcaagctattcaatgggaaagctgcttctttctttaaaacaaacaaacaaaaaaaaccttcagtggaaagccaaattccaaaaggttatataccaagcttgtccaactcgcagctcgtcggccaggacatgcagcccagaatagctttgaatgtggccccaacacaaatttgtaaactttcttagaaattgtaattattattattatttttttttggtaactttttttaaagctcatcagctatcgttagtgtattttatgtgtggcccaagacagttcttcttcttgccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgacttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttcccgaattc

SEQ ID NO: 2756 - DNA, 3850 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagattttctataagaagcatatgctggttttataatctcagaaaagatacgttggagacagtctgtattagcgcttaccatgtagaaggcatactcttccttagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaagtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 2757 - DNA, 3894 bp, Homo sapiens; identical to SEQ ID NO: 2752

SEQ ID NO: 2758 - DNA, 2516 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagta

SEQ ID NO: 2759 - DNA, 1741 bp, Homo sapiens
cgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcc

SEQ ID NO: 2760 - DNA, 2986 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 2761 - DNA, 2984 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcc

SEQ ID NO: 2762 - DNA, 7787 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaaataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggt

SEQ ID NO: 2763 - DNA, 6529 bp, Homo sapiens
ggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtaaaaaaaaaaaaaaa

SEQ ID NO: 2764 - DNA, 6421 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggttgatgcaataaaggaaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggttttta

SEQ ID NO: 2765 - DNA, 7787 bp, Homo sapiens; identical to SEQ ID NO: 2762

SEQ ID NO: 2766 - DNA, 6529 bp, Homo sapiens; identical to SEQ ID NO: 2763

SEQ ID NO: 2767 - DNA, 7787 bp, Homo sapiens; identical to SEQ ID NO: 2762

SEQ ID NO: 2768 - DNA, 7787 bp, Homo sapiens; identical to SEQ ID NO: 2762

SEQ ID NO: 2769 - DNA, 3578 bp, Homo sapiens
gattcggaagtgaagggccctgggcgacccggcgagtagaggcaacaccaacactcctccttagcgaggggtctccccgccgcggtggctgcccggccccaaggacaggagggatttgtgcactgactcctgaccccgtcctccagcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcaaaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtgtaaatatcactttagtgtcttttttttaagctaaccttgtatgccttttctctcatttcagaacacagatatgtagaactcttcttgaattctacagcaggagcaagcggtggtgcttatggtagccaaatgatgggaggcatgggcttgtgtaaatatcgttagtttttttaaaaaccaaaacgtttatatctgtataagtcaattataagttaagttaatctatttatttaataagtttagcataagaaacttaggcaaagcagtttcttgatatttgagttttgtatctggcttacttaaatccttgtgagttatgaagttccttaggatagataattcaaattaggtttaagtagtcttgggggaggggactacggagtgaaactacttaaattttctaagtataaagtttaaatcaatagcaaaacaggattaagataaatgtgggcataattaggtgtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttatagacagtaggcagaaggaggcagagggttacagtaatgtaagatcaagactggaaaatgatagctatagaattacaagcccggtaccaccaggtaccacatcacataagaaaaaaggttctaatgttttcttaacttaacagcaaaccagtccagctacgggggcccagccagccagcagctgagtgggggttacggaggcggctacggtggccagagcagcatgagtggatacggtaaagcctgtttgttactgtacttagagtaagttatggtaaagcctgttcgttactgtacttagagtaagttatggtaaagcctcttactgtacttagagtaagtcgcaggcaggtgcctttagttgggaagatgcaggctcctttcggtgaaactgggttatgaaatgtatgctttcaatccaaatgtaactgtttttactagctaattttcagaaacaatcattgggagggggaagtgttctttgaattaagaactagtcattgcagctttggaatactgtcgagccagaaaatatctgcctccatgtattaaaacattaaataaagttgttcacttttttgtcttttggttagcattaagtcagttttagacagagggagaatttgaaatagtagaatggtggttgggttcaggatcgtatttattagtcagttaacctaggattggttttatttattttttttcaattggtctaaagaatggtgattttggtattatagtcttaccctacaaaatccttttgcagaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaattctgaggccttgatttaaatctttcattgtattgtgatttccttttaggtatattgcg

SEQ ID NO: 2770 - DNA, 2201 bp, Homo sapiens
ttttttttttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttattttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 2771 - DNA, 2163 bp, Homo sapiens
tttgtttcgacgccggaccgcgtaagagacgatgatgttgggcacggaaggtggagagggattcgtggtgaaggtccggggcttgccctggtcttgctcggccgatgaagtgcaaaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 2772 - DNA, 2249 bp, Homo sapiens
gattcggaagtgaagggccctgggcgacccggcgagtagaggcaacaccaacactcctccttagcgaggggtctccccgccgcggtggctgcccggccccaaggacaggagggatttgtgcactgactcctgaccccgtcctccagcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcaaaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtgttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaattctgaggccttgatttaaatctttcattgtattgtgatttccttttaggtatattgcg

SEQ ID NO: 2773 - DNA, 2201 bp, Homo sapiens; identical to SEQ ID NO: 2770

SEQ ID NO: 2774 - DNA, 3377 bp, Homo sapiens
atggctattttctatccgttcctgaagaagcctgggtgccgagttctcctccccagagaccacacccagcgctcagggctggccgcagcggcttccctgaaaatcagccaactgcaaggcttatcgaaatcatcaggtcgtgtgctacacatgtgtaaaaagaggaaagcggactttaaatgtgctgcggttggtggtagcaagcaggaatttagcttgaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatacactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgtatagatgatattactatctgctattctgcctttgttctgaaacaattgctttgtcagctaatttcattcaatatt

SEQ ID NO: 2775 - DNA, 1635 bp, Homo sapiens
atgagttccttcagctacgagccgtactactcgacctcctacaagcggcgctacgtggagacgccccgggtgcatatcagcgtgcgcagcggctacagcaccgcacgctcagcttactcaagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctagcggcggaagatgccaccaccaacgagaagcaagcgctccgaggcgagcgcgaagaagggctggaggagaccctgcgcaacctgcaggcgcgctatgaagaggaggtgctgagccgcgaggacgccgagggccggctgatggaacgccgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcacggtgctgaccgagagcgccgccaagaacaccgacgccgtgcgcgccgccaaggacgaggtgtcggagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgctgcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagaccgaagtggaggaaaccattgaggcgtctaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattga

SEQ ID NO: 2776 - DNA, 3377 bp, Homo sapiens; identical to SEQ ID NO: 2774

SEQ ID NO: 2777 - DNA, 3377 bp, Homo sapiens; identical to SEQ ID NO: 2774

SEQ ID NO: 2778 - DNA, 3129 bp, Homo sapiens
gaaaatcagggccctctgagcaaagtggaaaggacgaccgccgcagctcctcgggccgtagctcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcagggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatacactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgtatagatgatattactatctgctattctgcctttgttctgaaacaattgctttgtcagctaatttcattcaatatt

SEQ ID NO: 2779 - DNA, 3377 bp, Homo sapiens; identical to SEQ ID NO: 2774

SEQ ID NO: 2780 - DNA, 1000 bp, Homo sapiens
gagtgcgccaggcgcggggagcctaggacctggagcgagagccgcctacctgcagccgccgcccacggcacggcagccaccgtggcgctcctgctgcgcttcgtgctcctgtgcagagtcgcggatttcatcagaggttggagtatcactactcctgagcagatgattgaaaaagccaaaggggaaactgcctatctgccatgcaaatttacgcttagtcctgaagaccagggaccactggacatcgagtggctgatatcaccagctgataatcagaaggtggatcaagtgattattttatattctggagacaaaaattatgatgactactatccagatctgaaaggccgagtacattttaagagtaatgatctcaaatctggtgatgcatcaataaatgtaacgaattttcagctgtcagatattggcacagatcagtgcaaagtgaaaagagctcctggtgttgcaaataggaagattcagctggtagttcttggtaagccttcaggtacaagatgttacgttgatggatcagaagaaattggaagtgactttaaattaaaatgtgaaccaaaagaaggttcacttccattacagtatgagtggcaaaaattgtctgactcacagaaaatgcccacttcatggttagcagggaagatgtgccgcctccaaagagccacacgtccactgccagaagctacataggcagtaatcattcatccctgggatccatatctccttccaacatggaaggatattccaagactcagtataaacaagtaccaagtgaagactttgaacgcactcctcagagtccgactctcccacctgctaaggtagctgcccctaatctaagtcgaatgggcgcgattcctgtgatgattcccgcacagagcaaggatgggtctatagtatagagcctccatacatctcatctgtgctctccgtgttcctttcctttttttgatatatgaaaacctattctggtctaaattttgtt

SEQ ID NO: 2781 - DNA, 3026 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttaga

SEQ ID NO: 2782 - DNA, 2764 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttaga

SEQ ID NO: 2783 - DNA, 702 bp, Homo sapiens
atgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcaggtacaagatgttatgttgatggatcagaagaaattggaagtgactttaaactaaaatgtgaaccaaaagaaggttcacttccattacagtatgagtggcaaaaattgtctgactcacagaaaatgcccacttcatgggaagatgtgccgcctccaaagagccgtacgtccgctgccagaagctgcataggcagtaatcattcatccctgggatccatgtctccttccaacatggaaggatattccaagactcagtataaacaagtaccgagtgaagactttgaacgcactcctcagagtccgactctcccacctgctaaggtagctgcccctaatctaagtcgaatgggcgtgattcctgtgatgattcccgcacagagcaaggatgggtctatagta

SEQ ID NO: 2784 - DNA, 1098 bp, Homo sapiens
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatag

SEQ ID NO: 2785 - DNA, 2302 bp, Homo sapiens
tcttgagtgcgcgaggcgcggggagcctaggacctggagcgagagccgcctacctgcagccgccgcccacggcacggcagccatcatggcgttcctgctgcgcttcgtgctcctgtgcggagtcgcggatttcaccagaagtttgagtatcactactcctgagcagatgattgaaaaagccaaaggggaaactacctatctgccatgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcaggtacaagatgttatgttgatggatcagaagaaattggaagtgactttaaactaaaatgtgaaccaaaagaaggttcacttccattacagtatgagtggcaaaaattgtctgactcacagaaaatgcccacttcatggttagcagaaatgacttcatctgttatatctgtaaaaaaaatgcttcttctgagtactctgggacatacagctgtacatcagaaacggagtgggctctgatcagtgcctgttgcgtgtaaacgttgtccctccttcaaataaagctggactaattgcaggagccattataggaactttgcttgctctagtgctcattggtcttatcatcttttgctgtcgtaaaaagcgcagagaagaaaaatacgaaaagtaagttcatcacgatatcagggaagatgtgccgcctccaaagagccgtacgtccgctgccagaagctgcataggcagtaatcattcatccctgggatccatgtctccttccaacatggaaggatattccaagactcagtataaacaagtaccgagtgaagactttgaacgcactcctcagagtccgactctcccacctgctaaggtagctgcccctaatctaagtcgaatgggcgtgattcctgtgatgattcccgcacagagcaaggatgggtctatagtatagagcctccatacgtctcatctgtgctctccgtgttcctttccttttttgatatatgaaaacctattctggtctaaattttgttactagcctcaaaatgtatccaaaaataagttaatcaggagctgtaaggaatatatttttttaaatttttctttggttatatcgaaatagttacaggcattaaagttagtaaagacaagtttaccatctgaaaaagctggattttctttaagaggttgattataaaggtttctaaatttatcagtacctaagtaagatgtagcactttgaatatgaaatcataagtgaagacattggtgaacttacttgcataccaagttgatacttgagtaaccatctgaaagtggtacttgataatttttaccgttatttttaggatgtgtatctcatttatttatggcccactagtctcccccaaattagtacagaaacatccatgacaaaattacacatgtgtgtttgtacttgttttcacagctccttggaaaactctgtgttaggaatatctctaaaaacatagaaaactctacagtggtttagaaattactaattttacttctaagtcattcataaaccttgtctatgaaatgatttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtggtctcatgccttgagatctgtggtggtctttaaaatggtggccagccagatcaaggatgtagtatctcatagttctggactaaatactggctttccactttaggtgatatttttcttattagaaaaatattataactcatttattgtttgacagttatagattgaaatttcctaattctaaattttaagtggttcttcagtttcagtgctttatgttgtttgttgttggtttggcatggcattacatattatatgttctagaaacatgtaatcctaaatttaccctcttgaatatgatccctagatgatatttttatcataaatgcagaataatcaaatatatttt

SEQ ID NO: 2786 - DNA, 2302 bp, Homo sapiens; identical to SEQ ID NO: 2785

SEQ ID NO: 2787 - DNA, 11920 bp, Homo sapiens
gttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagatacattctccaaattaccccagtccttataggagcaacacagactgttcttgggtcattcgggttgacagaaatcatcgtgttctcttgaacttcactgactttgatcttgaatcacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcgtcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcagggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctattctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacatacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacgtttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgt

SEQ ID NO: 2788 - DNA, 2616 bp, Homo sapiens
gagtggcatgctttgacagcaagtggactccgagtccagggcagagcctcagacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaactgggcac

SEQ ID NO: 2789 - DNA, 2616 bp, Homo sapiens; identical to SEQ ID NO: 2788

SEQ ID NO: 2790 - DNA, 2787 bp, Homo sapiens
gagtggcatgctttgacagcaagtggactccgagtccagggcagagcctcagacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaactgggcac

SEQ ID NO: 2791 - DNA, 2787 bp, Homo sapiens; identical to SEQ ID NO: 2790

SEQ ID NO: 2792 - DNA, 2776 bp, Homo sapiens
cagggcagactggtagcaaagcccccacgcccagccaggagcaccgccgcggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttggccacagctcttgaggatgtcaccaattaaccagaaatccagttattttccgccctcaaaatgacagccatggccggccggtgcttctgggggctcgtcggggggacagctccactctgactggcacagtctttgcatggagacttgaggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaaataaaacttcaat

SEQ ID NO: 2793 - DNA, 2787 bp, Homo sapiens; identical to SEQ ID NO: 2790

SEQ ID NO: 2794 - DNA, 1065 bp, Homo sapiens
atgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattag

SEQ ID NO: 2795 - DNA, 3362 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagtttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcaggtccccatttttctgcctctgtaccatttacatt

SEQ ID NO: 2796 - DNA, 1216 bp, Homo sapiens
cttctgggcgctaagggagctgacggagagggccaccgcccagcaatagacggtgcctcagcctgccgagctgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagtaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccattaactatctgttatccagaatacacaggttccaatacatatgaagaggcagctgcctatattcaatgccagtttgaagatctgaacagaagaaaagataccaaggagatctatacccacttcacctgtgccacagacacgaagaatgtgcagtttgtttttgatgctgttacagatgtcatcattaaaaacaacttaaaggaatgtggactttattgagaagcatggatgttaggtgaaaag

SEQ ID NO: 2797 - DNA, 13235 bp, Homo sapiens
atggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggtttgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgat

SEQ ID NO: 2798 - DNA, 13449 bp, Homo sapiens
atggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaa

SEQ ID NO: 2799 - DNA, 13449 bp, Homo sapiens; identical to SEQ ID NO: 2798

SEQ ID NO: 2800 - DNA, 13449 bp, Homo sapiens; identical to SEQ ID NO: 2798

SEQ ID NO: 2801 - DNA, 13449 bp, Homo sapiens; identical to SEQ ID NO: 2798

SEQ ID NO: 2802 - DNA, 780 bp, Homo sapiens
ccacgcgtccggcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggagagagagaaattcataacaaatccgactaccagaaaaaaaaaaaaaaa

SEQ ID NO: 2803 - DNA, 3497 bp, Homo sapiens
gagaggcgttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatg

SEQ ID NO: 2804 - DNA, 3849 bp, Homo sapiens
gagaggcgttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctac

SEQ ID NO: 2805 - DNA, 1008 bp, Homo sapiens
atggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtag

SEQ ID NO: 2806 - DNA, 1352 bp, Homo sapiens
ccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagtta

SEQ ID NO: 2807 - DNA, 1179 bp, Homo sapiens
gaaggagtagtaactgctcctcctgttcgacagtcagctgcatcttcttttgcattgccagccgagccacatcgctgagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgacgcccccatgttcgtcatgggtgtgaaccatgagaagtatgacaacagcctcaagatcatcagcaatgcctcctgcaccaccaactgcttagcacccctggccaaggtcatccatgacaacttcggtatcgtggaaggactcatgaccacggtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtccccc

SEQ ID NO: 2808 - DNA, 1352 bp, Homo sapiens; identical to SEQ ID NO: 2806

SEQ ID NO: 2809 - DNA, 2924 bp, Homo sapiens
gacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcaggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgaccaggctactgtcagctcccctcggagaaaactgtgcagtctgcgtgtgaacagctcttctcctttagagcacaatggatctcgagggatcttccatacctaccagttctgcgcctcgaggccgcgactctaga

SEQ ID NO: 2810 - DNA, 3453 bp, Homo sapiens
gagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaa

SEQ ID NO: 2811 - DNA, 3453 bp, Homo sapiens; identical to SEQ ID NO: 2810

SEQ ID NO: 2812 - DNA, 3187 bp, Homo sapiens
cacttcttgctcgttccctcccatccccccaagccagtagctgtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgg

SEQ ID NO: 2813 - DNA, 1041 bp, Homo sapiens
atggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttaccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatagatatattgaactcttcttgaattctactcctggaggcggctctggcatgggaggttctggaatgggaggctatggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactga

SEQ ID NO: 2814 - DNA, 2367 bp, Homo sapiens
tgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaaggggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2815 - DNA, 2201 bp, Homo sapiens
caccggagaacttctccagagcgctacggcacggttccttctacacactggcagaactgccattgccatcgccccgaggcggcagaatggtacgctctgaaaactggatggttctaacgtaagcaagaaaaacgcatttaaatcaaacggtattgagatggattgggttatgaaacataatggtccaaatgacgctagtgatgggacagtacgacttcgtggactaccatttggttgcagcaaagaggaaatagttcagttctttcaaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2816 - DNA, 2183 bp, Homo sapiens
tgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaaggggcatttaaatcaaacggtattgagatggattgggttatgaaacataatggtccaaatgacgctagtgatgggacagtacgacttcgtggactaccatttggttgcagcaaagaggaaatagttcagttctttcaaggtatattgagatcttcagaagtagcaggagtgaaatcaaaggattttatgatccaccaagaagattgctgggacagcgaccgggaccatatgatagaccaataggaggaagagggggttattatggagctgggcgtggaagttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2817 - DNA, 2394 bp, Homo sapiens
cacttcttgctcgttccctcccatccccccaagccagtagctgtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2818 - DNA, 2542 bp, Homo sapiens
caccggagaacttctccagagcgctacggcacggttccttctacacactggcagaactgccattgccatcgccccgaggcggcagaatggtacgctctgaaaactggatggttctaacgtaagcaagaaaaacgcatttaaatcaaacggtattgagatggattgggttatgaaacataatggtccaaatgacgctagtgatgggacagtacgacttcgtggactaccatttggttgcagcaaagaggaaatagttcagttctttcaaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgg

SEQ ID NO: 2819 - DNA, 2349 bp, Homo sapiens
cacttcttgctcgttccctcccatccccccaagccagtagctgtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2820 - DNA, 2228 bp, Homo sapiens
tgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaaggggcatttaaatcaaacggtattgagatggattgggttatgaaacataatggtccaaatgacgctagtgatgggacagtacgacttcgtggactaccatttggttgcagcaaagaggaaatagttcagttctttcaaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2821 - DNA, 2305 bp, Homo sapiens
actcgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaatcttgaact

SEQ ID NO: 2822 - DNA, 3629 bp, Homo sapiens
gttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagta

SEQ ID NO: 2823 - DNA, 6540 bp, Homo sapiens
aggtctccgcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggctggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtctcccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcaaaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 2824 - DNA, 3376 bp, Homo sapiens
ggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaacgtgtttgtgggaaaaggacagctgatcacagggatggaccaggctcttgttgggatgtgcgtaaacgagagacatttcgtgaagattcccccaaagcttgcctacggaagtgaaggagtttctggtgtgatcccccccaattcagtgcttcattttgatgtacttctgatggatatttggaattctgaagaccgggttcagattcacacctatttcaagcccctgagttgccctcagaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggcagtacctgaaaactgtgagcggttaagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacaggatgaactctaaacctggcacgaaccagatggtgccagggagtacgtgacaccaagccaactgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaagaatatatagtgtcagacggaagttataatcatcttggaggaaccataagaaaaagtgtccagggtatctatataaagagggttaaatttttttttaacttgctggttaaaacattttagaaatattcttgagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgtattcaagcgattctcctgtctcagcctcctgagtagctgggactacaggtgtgcaccaccacgcccggctaatttttgtatttttggtagagacggggtttcactgtgttggccaggatggtctcaatctcgacctcgtgatccgcccacctcggcctcccaaagtgttgggattacaggcatgaatcaccatgcctagccacttagttttttgtcattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgctgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatatta

SEQ ID NO: 2825 - DNA, 2517 bp, Homo sapiens
ggcacgagggtgagccggagagggtgaagcaggcaggaagctgcaggccggcggtggatggggccaggaagcatgcagggggagtgaggaccgtgtatgagagaaacactgcccaagagagaagaaagaaaatcacaggacccgaggaaaaagaatgagtggtgtgttcagagatgacacatgacaacaaattgtttgcttggaggattttcttacgcgtgcgtgtttaaactggcctcaaggaggaagaagaaacatgcgttcctggatgactgagttctggaatattctgtcataagactttgcaactggagtagccccagaaaaaggcaggcagtgggagttggctccctccccaaagccatccctgagttggctttgttttgggttcctcccaggtggaatttaggcaaaacttacagtattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcccgaggggtacatgttcatatggaatggtgaggtgtcacccaacctttttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagctgaggaatttaaactcaaagaccaggaagccaaacaggatgaactctaaacctggcacgaaccagatggtgccagggagtacgtgacaccaagccaactgtgtggcagaacgtgcagtgagggtgcaagggtctttcagaagttgcatcattagccagtagtaggtgggtcacatagtacctggtgtacacatcggggtgggttgatatatggggtgagaagtttaggctgatcgccagtgatagtaaacaaaatctgtgcagagggccttagcatgggatgtgtccagtattgaaaaggctgcactgccaaccatgatttgtgaaccttctgggaaattttgttattaaaagaatatatagtgtcagacggaagttataatcatcttggaggaaccataagaaaaagtgtccagggtatctatataaagagggttaaatttttttttaacttgctggttaaaacattttagaaatattcttgagatgggcaggagagtcaaagggcttgcttgccccagcagagttcccagcagacagccatggctcttcccagcagcctgtgcaaattctgatgatgaccccacccccgcacacgcacacgcacatcatgcttttccagctcatcacaccccgccccactatgggcctaccattaatagtgtatatcttggaggttaaaagagccttttggacagaaaactgggccaggaaaaggcatctcagaccacaaatagagaatttgattcctcatttgccacataagtcatctgcttagcttttcctttctttttttttttttttttttttttggaggcagagtctccgtttgtcgccaggctggagtgcagtggtgccatctcggctcactgcagcactgtctcggctcactgcagcctccgcctcccgtattcaagcgattctcctgtctcagcctcctgagtagctaggactacaggtgtgcaccaccacgccccgctaatttttgtatttttggtagagacggggtttcaccgtgttggccaggatggtctcaatctcgacctcgtgatccgcccacctcggcctcccaaagtgttgggattacaggcatgaatcaccatgcctagccacttagttttttgtcattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgctgcaagacagcaatgacagtccacctgccggcctgattcctgcatcatggaataaccacatggctaccttctatcctctgttcccaaatggtggtggcacttatcctgaagtcatcaatgatttccctttgaaactactttattttactaatttaaactattttgtactgatgtagccctgaggtagttcatgaaaatgctgtgcactcattccatggaataaatgttggaaagctgatcttttctgatataaaatgttgaattataaaaaaaaaaaaaaaaaaaaaaaaaaaaaaaaaaaaaaaaaaaaaaaaaaaaaaaaa

SEQ ID NO: 2826 - DNA, 1997 bp, Homo sapiens
acgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagagggggattgggggctggtgccagccttcctctgcagctgacctctgttgtcctccccttgggcggctgagagccccagctgacatggaaatacagttgtt

SEQ ID NO: 2827 - DNA, 1239 bp, Homo sapiens
atgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctag

SEQ ID NO: 2828 - DNA, 2410 bp, Homo sapiens
caggagcccacggcgcagcgccccgcgcaggcctggacgcggggacggccgcggcggccgggacaggggtcaccccgcggggccctccagggtgggccgccccacgaccccaggccaggccgaaacgggaatcctccagaccccagaagctgggccgggctgaccccgcgggcgcgagcggcgggaactgtaggcgcggcaggcgcaccaccaccccgccccccgcccgggcgctgtgcgcgtgcgccgaggttgccccgcccaggccaggccccgctccgccccgccccgcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 2829 - DNA, 1997 bp, Homo sapiens; identical to SEQ ID NO: 2826

SEQ ID NO: 2830 - DNA, 3697 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcatctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaacagccccatgtctgtgtccatcacccactgctaggtagtcaaagaagtggggtgagggcatgcagagtgtgggtggccaggcttcgcagcccatgggtgggactctggggagacagcagcagcagcagccgccgaagccccagctgcaaggccaccagacgcactcctgtgcctggttcctcagtccccaacaccaggtagcaagctctgggcagctgggcctggtagacctcatcttctgtcttctctggtggccctggctct

SEQ ID NO: 2831 - DNA, 3763 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcatctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaacagccccatgtctgtgtccatcacccactgctaggtagtcaaagaagtggggtgagggcatgcagagtgtgggtggccaggcttcgcagcccatgggtgggactctggggagacagcagcagcagcagccgccgaagccccagctgcaaggccaccagacgcactcctgtgcctggttcctcagtccccaacaccaggtagcaagctctgggcagctgggcctggtagacctcatcttctgtcttctctggtggccctggctct

SEQ ID NO: 2832 - DNA, 3499 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 2833 - DNA, 3439 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcatctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaacagccccatgtctgtgtccatcacccactgctaggtagtcaaagaagtggggtgagggcatgcagagtgtgggtggccaggcttcgcagcccatgggtgggactctggggagacagcagcagcagcagccgccgaagccccagctgcaaggccaccagacgcactcctgtgcctggttcctcagtccccaacaccaggtagcaagctctgggcagctgggcctggtagacctcatcttctgtcttctctggtggccctggctct

SEQ ID NO: 2834 - DNA, 2235 bp, Homo sapiens
ccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaattct

SEQ ID NO: 2835 - DNA, 1906 bp, Homo sapiens
agaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggacgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaa

SEQ ID NO: 2836 - DNA, 2203 bp, Homo sapiens
ttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 2837 - DNA, 1180 bp, Homo sapiens
atgttccggtgtggaggcctggcggcgggtgctttgaagcagaagctggtgcccttggtgcggaccgtgtgcgtccgaagcccgaggcagaggaaccggctcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaattct

SEQ ID NO: 2838 - DNA, 2202 bp, Homo sapiens
cggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaattct

SEQ ID NO: 2839 - DNA, 1539 bp, Homo sapiens
ccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgttttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagatgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgcaaagttttgaaaatatatttgaacaatttgaatataaattcatcatttagtcctcaaaatatatacagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaaccaaaaaaaaaaaaaaaaaaa

SEQ ID NO: 2840 - DNA, 11433 bp, Homo sapiens
aggctgcttcgttgcacacccgagaaagtttcagccaaacttcgggcggcggctgaggcggcggccgaggagcggcggactcggggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 2841 - DNA, 10554 bp, Homo sapiens
gttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacagtaccgctacatctcactcagaggtgtcaccccttcgatggctgttacaactgagaagacaagaaatagtaggccaggcacggtggctcaccctgtaatcccagcactttgggaggccgaggcaggcggatcacgaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaa

SEQ ID NO: 2842 - DNA, 10418 bp, Homo sapiens
gttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaa

SEQ ID NO: 2843 - DNA, 9722 bp, Homo sapiens
tcatctggaattatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgtgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtaaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggaccctcaccatcctctgtgcagcacacacagtgcagggagccagtggcgatggcgatgactttcttcccctgg

SEQ ID NO: 2844 - DNA, 905 bp, Homo sapiens
gcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatcagc

SEQ ID NO: 2845 - DNA, 888 bp, Homo sapiens
ggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaa

SEQ ID NO: 2846 - DNA, 4951 bp, Homo sapiens
cgaaagcgctgagattttgtatttctaacaggctcccaggtaatgcttgggaagaactgttgcttcttggacagcaacacttacaaggcaacgtgatcttgagctccacctcgaaggatgtgagctgggaaagttccagctcacagagatttagtcacttgagaaatggtccacttcctccaaggtgtttcttggatgccccaaagggatgaaaacaagaagtgaccgtgggcgaggaggaggagctggccgacctcctcggttgccagcccgtcggagctcaccagctaggcgagggcgggaagacagcccccgggccggcccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtt

SEQ ID NO: 2847 - DNA, 3951 bp, Homo sapiens
cgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaaaaaaaaaaaaaaaaaaaaaaaaaa

SEQ ID NO: 2848 - DNA, 4951 bp, Homo sapiens; identical to SEQ ID NO: 2846

SEQ ID NO: 2849 - DNA, 7037 bp, Homo sapiens
gctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtaccaaaaaaaaaaaaaaaa

SEQ ID NO: 2850 - DNA, 6896 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaatttgttggttggctggtttgaacgatagaaatatgcagcatgcaatatatgcttatatttcattt

SEQ ID NO: 2851 - DNA, 6896 bp, Homo sapiens; identical to SEQ ID NO: 2850

SEQ ID NO: 2852 - DNA, 8850 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattct

SEQ ID NO: 2853 - DNA, 8411 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattct

SEQ ID NO: 2854 - DNA, 8435 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattct

SEQ ID NO: 2855 - DNA, 8206 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtatacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattc

SEQ ID NO: 2856 - DNA, 9448 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattc

SEQ ID NO: 2857 - DNA, 1819 bp, Homo sapiens
tggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatc

SEQ ID NO: 2858 - DNA, 1819 bp, Homo sapiens; identical to SEQ ID NO: 2857

SEQ ID NO: 2859 - DNA, 1819 bp, Homo sapiens; identical to SEQ ID NO: 2857

SEQ ID NO: 2860 - DNA, 1819 bp, Homo sapiens; identical to SEQ ID NO: 2857

SEQ ID NO: 2861 - DNA, 1819 bp, Homo sapiens; identical to SEQ ID NO: 2857

SEQ ID NO: 2862 - DNA, 1822 bp, Homo sapiens
cgcccttggcccagccgctcgctcggctccgctccctggctcggctccctgcctccgcgtcgcagcccccgccgtagccgcctccgagcccgccgccacatcctctgagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatc

SEQ ID NO: 2863 - DNA, 982 bp, Homo sapiens
actgttgtactcacttagagggaacatagcctttgtttccttacttaaccatgtgagccacagagtaagaagaaaaccgtctctttaaaagctgctatttaggtagctgccttcatggcagataaatcttttccacaggtttggaaaatatcaaagatgcatctgtttcataattacatggtggctttctacctaatgaatgcctgtgtaggctgctacgttaagcatacaaagaggataggagaagaaagttacttcgtatttatttttcaggcttttcctgtctgtgttctcacttcgttattgtggggtttctgcagactgagtccctgtggaagagaggttgtgtcctgctcattgtggtacagcagtggcttaagggagaactggagccctgacttcacccccaccccactccctttatttgacctgggattaaaaaaaaaaaaagacaacttgcatttcaaggtgagttagcttctgatcttaatataacttattttccttcaggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgtaagtgtacatgggggcagcagggtgggaggggtggggttggagcatgtgtggtaaggggattgcttttcactgttttttgttttttttttttttaagaaagcccagtttttaaccactgtaaagtgagtttgttggctttagatgagccacatggcctgcggctatcttttgtttcccacctacccatttcctggagtgtcttatatccttttcactctgtgaacagtttattttgccacag

SEQ ID NO: 2864 - DNA, 1539 bp, Homo sapiens
gggaggatgtggcgggtataaaagccccacccaggccagccggctctgctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagaaaaaattagccgggcgtgggggcgggctcctgtagtcccagctactccggaggctgaggcaggagaatggcgtgaacccaggaggcggatgagccaagatcacgccactgcactccagcttgggcaacagagcgagactcgcggtggctcatgcctgtaatcccaacactttgggaggccaaggtgggcggatcatgaggtcaggagatcgtgaccatcctggctaatacagtgaaaccccgtctctactaaaaatacaaaaaaattagccaggcatggtggcgggcgcttgtagtgccagctactcgggaggctgaggcaagagaatggtgtgaacctgggaggc

SEQ ID NO: 2865 - DNA, 1635 bp, Homo sapiens
gctcagcatttggggacgctctcagctctcggcgcacggcccaggtaagcggggcgcgccctgcccgcccgcgatgggccgccagctagcggggtgcggagacgctgggaagaaggcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcaaaaaaaaaa

SEQ ID NO: 2866 - DNA, 1622 bp, Homo sapiens
ggggacgctctcagctctcggcgcacggcccaggtaagcggggcgcgccctgcccgcccgcgatgggccgccagctagcggggtgcggagacgctgggaagaaggcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctg

SEQ ID NO: 2867 - DNA, 1622 bp, Homo sapiens; identical to SEQ ID NO: 2866

SEQ ID NO: 2868 - DNA, 1562 bp, Homo sapiens
attccagcaggaaaacaggatggaggaaggtacaaagcatgaatgagcctggcctgtccagcagtggcacatggagcggtgaagagtgaagatgtgggggaatgaggctgcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaaggtaagggcaggcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagaaaaaattagccgggcgtgggggcgggctcctgtagtcccagctactccggaggctgaggcaggagaatggcgtgaacccaggaggcggatgagccaagatcacgccactgcactccagcttgggcaacagagcgagactcgcggtggctcatgcctgtaatcccaacactttgggaggccaaggtgggcggatcatgaggtcaggagatcgtgaccatcctggctaatacagtgaaaccccgtctctactaaaaatacaaaaaaattagccaggcatggtggcgggcgcttgtagtgccagctactcgggaggctgaggcaagagaatggtgtgaacctgggaggc

SEQ ID NO: 2869 - DNA, 1539 bp, Homo sapiens; identical to SEQ ID NO: 2864

SEQ ID NO: 2870 - DNA, 1539 bp, Homo sapiens; identical to SEQ ID NO: 2864

SEQ ID NO: 2871 - DNA, 1341 bp, Homo sapiens
cttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttaaaaaaaaaaaaaaaaa

SEQ ID NO: 2872 - DNA, 665 bp, Homo sapiens
ggagcgcagcactgccgcccggcccctccagcttcccggaccacggccaacctcgagcgcaccttcatcaccatcaggccggacagcatgcagtgcggcctggtgggcaagatcatcaagcgcttcgagcagaaggggttccgcctcgtggccatgaagttcctcccggcctctgaagaacacctgaagcagcactacattgacctgaaggaccgcccattcttccctgggctggtgaagtacatgaactcagggccggtcgtggccatggtctgggaggggctgaacgtcgtgaagacaggccgagtgatgcttggggagaccaatccagcagattctaagccaggcaccattcgtggggacttttgcattcaggttggcaggaacatcattcatggcagtgattcagtaaaaagtgctgaaaaagaaatcagcctacggtttaagcctgaagaactggttgactacaagtcttgtgctcatgactgggtctatgaataagaggtggacacagcagcagtctccttcagcacggtgtggtgtgtccctggacacagctcttcattctactgacttagaggcaacaggattgatcattcttttatagagcatatttgccaataaagcttttggaagctggaaaaaaaaaagagagaaagagagaa

SEQ ID NO: 2873 - DNA, 647 bp, Homo sapiens
ccacgcgtccgcctcccgttccctcttccgcttgcgctgccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 2874 - DNA, 1573 bp, Homo sapiens
gccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggtaagtccggggacaggagggtggatgacttttatgcaacaccatttaaagcagacgtcatggcgtatcctactttcagaagaatctgtgcccttttttttttttttttttcttgagacggagtctccttcttgcactccagcctgggcaacaagaacaaaactccgtctcaaaaaaaaaaaaaaaaaagctttcacacatagcttcttccctaggttacttaattttaagcaagacaacaagggagccataagtggtaattcctgtgtagtacagcaaaaaatgctaggtgtggagaagggaagcattctagccacatccatgagtactttgtccatgggtgtgtcacttaaccttttgattccctcacctgtacacagtctgttcaaaacctttacaaagttgtgaggttgaagtgggataaagggatttttattaataagcagtgttatgtcatggttgggctttgcaaatcagtgttataagaaaatgcagcagagctggcctatgataatgaacacatcatatctagttgggatgttgatctgcagtgggtttgagtatcactgtattttccaaaatttgcggaggagtgttttatgtcttcggcaatcttggggtacaagcactcttttgatggggaggccagacttggaagcataatacagttgaaacaaggaatgttttaaatcaagcacttttacagttgtatagctgcttttaaaaggaaatgctttgggggtataaattggtctgttgcttcaagtggcaatttggctgaaagagtctggagtgctgtccattgcggtacccattaaacagacttttgcactttaaaacatggcaacttgtaattgttttctttcttaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 2875 - DNA, 1253 bp, Homo sapiens
gtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggacact

SEQ ID NO: 2876 - DNA, 708 bp, Homo sapiens
gccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggacact

SEQ ID NO: 2877 - DNA, 1253 bp, Homo sapiens; identical to SEQ ID NO: 2875

SEQ ID NO: 2878 - DNA, 1132 bp, Homo sapiens
gaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgataccagctacttgggaggctgagatgggagaccagcctgggtaacatagcaagaccctgtctcactaa

SEQ ID NO: 2879 - DNA, 576 bp, Homo sapiens
tgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgttggagagattatcaagcgttttgagcagaaaggattccgccttgtgggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatcca

SEQ ID NO: 2880 - DNA, 7968 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatggaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagctgctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcaggcaagaaatacctgaaacaccagacctttgcacatgaagtcgatggccgatctgagcaggtgcatggcgtcatcaacctggggaactccctgattgagcgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacaccaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcggagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcatgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 2881 - DNA, 8038 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagctgctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcaggcaaataatataatttctgtttcattttcccttcagaggaaatacctgaaacaccagacctttgcacatgaagtcgatggccgatctgagcaggtgcatggcgtcatcaacctggggaactccctgattgagcgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacaccaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcggagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcatgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 2882 - DNA, 8004 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagctgctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcaggcaagaaatacctgaaacaccagacctttgcacatgaagtcgatggccgatctgagcaggtgcatggcgtcatcaacctggggaactccctgattgagcgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacaccaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcggagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcatgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 2883 - DNA, 8000 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagctgctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcaggcaagaaatacctgaaacaccagacctttgcacatgaagtcgatggccgatctgagcaggtgcatggcgtcatcaacctggggaactccctgattgagcgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccaggtattcttaactagatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacaccaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcggagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcatgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 2884 - DNA, 7357 bp, Homo sapiens
aatgtctcagttctgttcccttcaggcttcgagaccaccgccttgctgtgtcccgtagtggactgagggcctgcaagagggagtgagggctagtggagggccagctgcctgtgggggctggacatcgtgtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgatcctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaat

SEQ ID NO: 2885 - DNA, 7357 bp, Homo sapiens; identical to SEQ ID NO: 2884

SEQ ID NO: 2886 - DNA, 7259 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaat

SEQ ID NO: 2887 - DNA, 7357 bp, Homo sapiens; identical to SEQ ID NO: 2884

SEQ ID NO: 2888 - DNA, 8850 bp, Homo sapiens; identical to SEQ ID NO: 2852

SEQ ID NO: 2889 - DNA, 8206 bp, Homo sapiens; identical to SEQ ID NO: 2855

SEQ ID NO: 2890 - DNA, 9448 bp, Homo sapiens; identical to SEQ ID NO: 2856

SEQ ID NO: 2891 - DNA, 1325 bp, Homo sapiens
atgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatt

SEQ ID NO: 2892 - DNA, 1473 bp, Homo sapiens
ggggagaagtgagctagtggcagcataaaaagaccagcagatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttct

SEQ ID NO: 2893 - DNA, 1325 bp, Homo sapiens; identical to SEQ ID NO: 2891

SEQ ID NO: 2894 - DNA, 1296 bp, Homo sapiens
ggggagaagtgagctagtggcagcataaaaagaccagcagatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttct

SEQ ID NO: 2895 - DNA, 1296 bp, Homo sapiens; identical to SEQ ID NO: 2894

SEQ ID NO: 2896 - DNA, 1411 bp, Homo sapiens
ctcttccagaggcaagaccaaccaagatgagtgccttgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccccactttaacactctatgtggggaaaaagcagcttgtagagattgagaaggttgttctacaccctaactactcccaagtagatattgggctcatcaaactcaaacagaaggtgtctgttaatgagagagtgatgcccatctgcctaccatccaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 2897 - DNA, 1245 bp, Homo sapiens
actgctcttccagaggcaagaccaaccaagatgagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaa

SEQ ID NO: 2898 - DNA, 1923 bp, Homo sapiens
gctgagcatcgccagggcgggcggcagggcgcggcctctccgccgggtgtacctcctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactattattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagtttt

SEQ ID NO: 2899 - DNA, 1693 bp, Homo sapiens
gtgggccacgccttccgggccccgcggctggccggctcctcgcgtcgtcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggttacagaatacctatatgc

SEQ ID NO: 2900 - DNA, 3059 bp, Homo sapiens
gtgggccacgccttccgggccccgcggctggccggctcctcgcgtcgtcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacaatcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaacagttttcttgtgtggcttgcatattgaagaattctaaaggaaaatatatctgcctac

SEQ ID NO: 2901 - DNA, 3206 bp, Homo sapiens
gtgggccacgccttccgggccccgcggctggccggctcctcgcgtcgtcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggtgtggctttagctgttattctctgtaacacccggcatattagtgacagtgttttcctagaagctgcaaaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacaatcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatgccttttttaatcccagtaaaatgggtaataatggctatccagaacagttttcttgtgtggcttgcatattgaagaattctaaaggaaaatatatctgcctac

SEQ ID NO: 2902 - DNA, 2902 bp, Homo sapiens
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgacgcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttataaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagagcaagca

SEQ ID NO: 2903 - DNA, 2423 bp, Homo sapiens
gaattccggctagaaatgaatatgtaagaaagcttatagtagtttaaatcatttgtagaaccagccgagtttctcaagtcgcctccagaccgcagacatgaaacttgtcttcctcgtcctgctgttcctcggggccctcggactgtgtctggctggccgtaggagaaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttgggccttggcctcccctgctgaaggtggggattgcccatccatctgcttacaattccctgctgtcgtcttagcaagaagtaaaatgagaaattttgttgtatattctctcctta

SEQ ID NO: 2904 - DNA, 2219 bp, Homo sapiens
cgcatgcgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagacgcacgtccgctcgcccggcgcccgagccagtccgcgcgcacgccgtctgcgccccgaaagccccgccccaaggcgcgcccgcccaccgctctccacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtg

SEQ ID NO: 2905 - DNA, 985 bp, Homo sapiens
gcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 2906 - DNA, 920 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 2907 - DNA, 3859 bp, Homo sapiens
tgcgggcggggcggggcgcgggagggcggggccggcgcggcgagcgcaccagcagcatcctggctcagccgcggcggtggcgggggcgcaaccagcgggccgaggcggcggcgccagcggctctttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttc

SEQ ID NO: 2908 - DNA, 3859 bp, Homo sapiens; identical to SEQ ID NO: 2907

SEQ ID NO: 2909 - DNA, 3822 bp, Homo sapiens
tggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctgaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtgaaaaaaaaaaaaaaaaaa

SEQ ID NO: 2910 - DNA, 3859 bp, Homo sapiens; identical to SEQ ID NO: 2907

SEQ ID NO: 2911 - DNA, 2169 bp, Homo sapiens
atgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctga

SEQ ID NO: 2912 - DNA, 3022 bp, Homo sapiens
gtggctgccggggaggccagagcgtggagcgctgcgcggcgcggcggccgggccctcgagacggggacggacacaccagcccctcagataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcccgaggaaggcttgtgtgtcctcagttaaaactgtgcatatcgaaatatattttgttatttaagcctgcgtccccgtaccgcgtgctttatttctatgagtttgcagagtttggtggtctcgccatccttggcccacgtcctgtagtcagccctgtggaatccgcggatatgaaaagttggccttccttatccacaggctcccccgtaagtcggccttccttatccacaggctcccctgctgaggattcatcccaccttggatggaaaatgcagtttttgtgggagatggaactggagggtacggagggctgactgcacatacaaatatacatacatgagtgtacatat

SEQ ID NO: 2913 - DNA, 3015 bp, Homo sapiens
gtggctgccggggaggccagagcgtggagcgctgcgcggcgcggcggccgggccctcgagacggggacggacacaccagcccctcagataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcccgaggaaggcttgtgtgtcctcagttaaaactgtgcatatcgaaatatattttgttatttaagcctgcgtccccgtaccgcgtgctttatttctatgagtttgcagagtttggtggtctcgccatccttggcccacgtcctgtagtcagccctgtggaatccgcggatatgaaaagttggccttccttatccacaggctcccccgtaagtcggccttccttatccacaggctcccctgctgaggattcatcccaccttggatggaaaatgcagtttttgtgggagatggaactggagggtacggagggctgactgcacatacaaatatacatacatgagtgtacatat

SEQ ID NO: 2914 - DNA, 2842 bp, Homo sapiens
gtggctgccggggaggccagagcgtggagcgctgcgcggcgcggcggccgggccctcgagacggggacggacacaccagcccctcagataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcccgaggaaggcttgtgtgtcctcagttaaaactgtgcatatcgaaatatattttgttatttaagcctgcgtccccgtaccgcgtgctttatttctatgagtttgcagagtttggtggtctcgccatccttggcccacgtcctgtagtcagccctgtggaatccgcggatatgaaaagttggccttccttatccacaggctcccccgtaagtcggccttccttatccacaggctcccctgctgaggattcatcccaccttggatggaaaatgcagtttttgtgggagatggaactggagggtacggagggctgactgcacatacaaatatacatacatgagtgtacatat

SEQ ID NO: 2915 - DNA, 3015 bp, Homo sapiens; identical to SEQ ID NO: 2913

SEQ ID NO: 2916 - DNA, 3022 bp, Homo sapiens; identical to SEQ ID NO: 2912

SEQ ID NO: 2917 - DNA, 1052 bp, Homo sapiens
atgaaagattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 2918 - DNA, 6139 bp, Homo sapiens
agagaatctcgatgctggcctggagcagaaactgagctggaccactggagcctcgggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgaggcgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccccgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctgcg

SEQ ID NO: 2919 - DNA, 1098 bp, Homo sapiens
atggccgtcatggcgccccgaaccctcctcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtga

SEQ ID NO: 2920 - DNA, 1098 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtga

SEQ ID NO: 2921 - DNA, 1098 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtga

SEQ ID NO: 2922 - DNA, 3478 bp, Homo sapiens
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagttccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctgg

SEQ ID NO: 2923 - DNA, 3478 bp, Homo sapiens; identical to SEQ ID NO: 2922

SEQ ID NO: 2924 - DNA, 3344 bp, Homo sapiens
ggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacaaaatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgc

SEQ ID NO: 2925 - DNA, 4058 bp, Homo sapiens
ccgctttacgcctgcctcctggggctctgcgcgctcctgccccggtttgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttgttctgaggggctgaggctggaaatagattgtacagacaagcaagggttgagtggtggttcccacacgaagtcatctcttaaacatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaac

SEQ ID NO: 2926 - DNA, 3392 bp, Homo sapiens
gcggagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcggcccccggccctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagtgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagttcggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcactctcagctttccctgccacatccagcttgttgtcccaatgaaatactgagatgctgggctgtctctcccttccaggaatgctgggcccccagcctggccagacaagacgactgtcaggaagggtcggagtctgtaaaaccagcatacagtttggcttttttcacattgatcatttttatatgaaataaaaagatcctgcatttatggtgtagttctgagtcctgagacttttccgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgataaaaaaaaaaaaaaaaaaaaa

SEQ ID NO: 2927 - DNA, 4058 bp, Homo sapiens; identical to SEQ ID NO: 2925

SEQ ID NO: 2928 - DNA, 1321 bp, Homo sapiens
aggagggagcagtcggtcgctgcgccccggcgggccactttcccgggaccccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgaggtaagggtgggaatgcttttttagcattgattgatttcccacaattgcagtctgagcaactggaatgtaactctctccattggataagtccatgatagtcctttgcttctttgtgatacatttgacttggaatatagtggcaggttattatttgggtgaaaacactatgctaagtcaatgaaaaatgccaaacctggattctcaagatgaatgctctttcattcatctcagtaaaacaaagcctaaaacaaacactcagatgtgggtgtatatttaacctgtttaatagcaattatgatatgtgtgattaggttcacttccatattttctgtgtaccaccctgtattgttcatagaacttttcgtgtattctcaaagaaaccttcttagttcctatgactttccgaatcttgctcatcctccaaagcatggtcaaccaag

SEQ ID NO: 2929 - DNA, 9432 bp, Homo sapiens
gccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagcgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggggtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcaactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccctggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacatggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagtgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggacctgatgtgaaaggaccacgggtgttgtaagctgggaccggaaccaaactggaatcaaacgcgactgtaaattgtatcttataacttattaaataaaacattgctccgtaaaaaaaaaaa

SEQ ID NO: 2930 - DNA, 9211 bp, Homo sapiens
gcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgaggctctcaaaggcctttgtgggccagaagaagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 2931 - DNA, 9094 bp, Homo sapiens
gcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagaagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccg

SEQ ID NO: 2932 - DNA, 6586 bp, Homo sapiens
gcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgagctgacgacacggattcccagtcatggcgcagccccttgaaagccctttcagagttctttaaaggtgacccgaagggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccaggggtcagagtcatgaactgctctgcccagatcctgtggggctggagggtgcagtttcatactggctctagg

SEQ ID NO: 2933 - DNA, 9444 bp, Homo sapiens
gcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagaagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 2934 - DNA, 9444 bp, Homo sapiens; identical to SEQ ID NO: 2933

SEQ ID NO: 2935 - DNA, 9409 bp, Homo sapiens
gcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgagctgacgacacggattcccagtcatggcgcagccccttgaaagccctttcagagttctttaaaggtgacccgaagggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgaggctctcaaaggcctttgtgggccagaagaagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 2936 - DNA, 2320 bp, Homo sapiens
ctcagctgcagttctctgatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatataccctggaggatctggaccgggagttcaaggcttttgcccatgctcaatggaaagcacaagtacgaagtatatattctctattaatgggttcatacaatgacatttttgacttatttttttcaaattgcaggagtttgtttaaagacaaaaaattagtagaatacttaaaggagagttcttttgatgcagtgtttctcgatccttttgataactgtggcttaattgttgccaaatatttctccctcccctccgtggtcttcgccaggggaatactttgccactatcttgaagaaggtgcacagtgccctgctcctctttcctatgtccccagaattctcttagggttctcagatgccatgactttcaaggagagagtacggaaccacatcatgcacttggaggaacatttattatgccaccgttttttcaaaaatgccctagaaatagcctctgaaattctccaaacacctgttacggagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaact

SEQ ID NO: 2937 - DNA, 2427 bp, Homo sapiens
tggggtcaggttttgtgctggtatttctcccacctactgtatcataggagcttagattcccagctgcttgctctcagctgcagttctctgatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatataccctggaggatctggaccgggagttcaaggcttttgcccatgctcaatggaaagcacaagtacgaagtatatattctctattaatgggttcatacaatgacatttttgacttatttttttcaaattgcaggagtttgtttaaagacaaaaaattagtagaatacttaaaggagagttcttttgatgcagtgtttctcgatccttttgataactgtggcttaattgttgccaaatatttctccctcccctccgtggtcttcgccaggggaatactttgccactatcttgaagaaggtgcacagtgccctgctcctctttcctatgtccccagaattctcttagggttctcagatgccatgactttcaaggagagagtacggaaccacatcatgcacttggaggaacatttattatgccaccgttttttcaaaaatgccctagaaatagcctctgaaattctccaaacacctgttacggagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctattt

SEQ ID NO: 2938 - DNA, 4061 bp, Homo sapiens
ggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatagtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacaatagcttttgcttgaaattggaaaaggccctattggaaaaacctttaatggggtggggaatgaaggttaaaaatgaaagatttttaaaacaaaaatgatagaattttttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttg

SEQ ID NO: 2939 - DNA, 1937 bp, Homo sapiens
caggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttactaaaaaaaaaaaaaaaaaaaaaaa

SEQ ID NO: 2940 - DNA, 6790 bp, Homo sapiens
cttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagggagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaaaaaaaaaaaa

SEQ ID NO: 2941 - DNA, 6936 bp, Homo sapiens
actgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaagggttccatgagccagatccgaattgaggctggagtgagtgcctgtgagccaggggtggccattctgccctaagttccatgcggacagccaggctgtgaagctgaatctagctgagattagactacacagacctctgagaccaatttcaactctgagacttgatgattcttccaaacagtcctccaaacagaacagatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagtgcttaagcagtatgtcaacagcactcagcaaaatggcttctccagcgacagtgcatctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacattatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 2942 - DNA, 6818 bp, Homo sapiens
atcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 2943 - DNA, 6818 bp, Homo sapiens; identical to SEQ ID NO: 2942

SEQ ID NO: 2944 - DNA, 6719 bp, Homo sapiens
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattcccactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgcggaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctgtacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgcgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 2945 - DNA, 2565 bp, Homo sapiens
agcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactac

SEQ ID NO: 2946 - DNA, 2654 bp, Homo sapiens
agcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaatgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctttgttttgtttttgttttttgaagacagtgtcttgctcttctgctcaaacagtaatgcagtggcatgatcaccattcattgcagtctcaaccttctgggctcaagcagtcctcccacctcagcctccctagtaactggaaccaca

SEQ ID NO: 2947 - DNA, 2654 bp, Homo sapiens; identical to SEQ ID NO: 2946

SEQ ID NO: 2948 - DNA, 897 bp, Homo sapiens
ctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatttccttttgtagctgtttcaattggctttgctgtaaataaaaagatagaatttggagttgtgtacagttgtgtggaaggcaagatgtacactgccagaaaaggaaaaggggccttttgtaatggtcaaaaactacaagtttcacaacaagaagatattaccaaatctctcttggtgactgagttgggctcttctagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagctcatagtcatccagttg

SEQ ID NO: 2949 - DNA, 2624 bp, Homo sapiens
agcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatggatcattgaccctattgatggaacaactaactttgtacatagatagaatttggagttgtgtacagttgtgtggaaggcaagatgtacactgccagaaaaggaaaaggtgccttttgtaatggtcaaaaactacaagtttcacaacaagaagatattaccaaatctctcttggtgactgagttgggctcttccagaacaccagagactgtgagaatggttctttctaatatggaaaagcttttttgcattcctgttcatgggatccggagtgttggaacagcagctgttaatatgtgccttgtggcaactggcggagcagatgcatattatgaaatgggaattcactgctgggatgttgcaggagctggcattattgttactgaagctggtggcgtgctaatggatgttacaggtggaccatttgatttgatgtcacgaagagtaattgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactac

SEQ ID NO: 2950 - DNA, 2654 bp, Homo sapiens; identical to SEQ ID NO: 2946

SEQ ID NO: 2951 - DNA, 1503 bp, Homo sapiens
gccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcaggcatcatggtggcttccctgcgcccaggaagccatatacacagatgcccattgca

SEQ ID NO: 2952 - DNA, 1988 bp, Homo sapiens
gccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 2953 - DNA, 1565 bp, Homo sapiens
gccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcaggcatcatggtggcttccctgcgcccaggaagccatatacacagatgcccattgca

SEQ ID NO: 2954 - DNA, 2165 bp, Homo sapiens
gccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtgggctgggactagaatgaggtgagcaaggcacttgccctcgggcgcaatatttaagaaggtgccataaaagtgtagtaatcaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 2955 - DNA, 1565 bp, Homo sapiens; identical to SEQ ID NO: 2953

SEQ ID NO: 2956 - DNA, 1157 bp, Homo sapiens
gtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaaaaaaaaaaaaaaa

SEQ ID NO: 2957 - DNA, 4502 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaaggtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacatt

SEQ ID NO: 2958 - DNA, 2236 bp, Homo sapiens
ctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataaaaaaaaaaaaaaaaaaaaaaaaa

SEQ ID NO: 2959 - DNA, 4502 bp, Homo sapiens; identical to SEQ ID NO: 2957

SEQ ID NO: 2960 - DNA, 3159 bp, Homo sapiens
tctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 2961 - DNA, 3159 bp, Homo sapiens; identical to SEQ ID NO: 2960

SEQ ID NO: 2962 - DNA, 3075 bp, Homo sapiens
atggttaattttacggtggatcagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcactcagctgtactagtgccattggaataataaatttgataaggtgtgaaaa

SEQ ID NO: 2963 - DNA, 5426 bp, Homo sapiens
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 2964 - DNA, 5536 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccag

SEQ ID NO: 2965 - DNA, 1301 bp, Homo sapiens
ccgcgggcgccgcagaactcaggggcttgggccccgccccaaccccgcgcgtgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctc

SEQ ID NO: 2966 - DNA, 1301 bp, Homo sapiens; identical to SEQ ID NO: 2965

SEQ ID NO: 2967 - DNA, 1708 bp, Homo sapiens
gcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccaccagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcagccgcgggcgccgcagaactcaggggcttgggccccgccccaaccccgcgcgtgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaaggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctc

SEQ ID NO: 2968 - DNA, 722 bp, Homo sapiens
gcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggtaacacgggggacgtggagggacggggagaagaagaggcacagagagagaaggaaggagaggtagaaagacaagtggggagagacagagagaaagagacacagacagagacggagggagagagggagggagagatagggagggaaacggagagggggagacagagagaagacagagagggagggagaggcccagagaaagggagggagagacagaaaaaagaacagagagagggacagaggggacagacggagacaggagaagaaggggaaagaaagaaacagggagagacgcagggagagtggaagagggagggagggagacaggcgggggagacagaacgagagagagggagagagacggagaaagagaaaaaagacagatag

SEQ ID NO: 2969 - DNA, 1562 bp, Homo sapiens; identical to SEQ ID NO: 2868

SEQ ID NO: 2970 - DNA, 1045 bp, Homo sapiens
atgtatactatttacgaaatcctgtgcaagctcagcttggagggtcatcactctacaccctcaggtgcatatgggtcagtcaaagcctacaccaactttgatgctgagggggatgctttgaacattgaaaggaccatcaggacaaaaggtgtgggtaagttcaccattgtcaacattttgaccaacagcaggaatgctcggagagaggatgttgcctttgcctagcagagaaggaccacaaaggaacttacatcagcactgaagtcagccttactggccacctggagacagtcattttgggcctattgaagacacctgctcagtatgatgcttctgagctaaaagcttccatgaaggggctgggaactgaggaggactccctcgttgagatcatctgctcaacaaccaaccaggagctccaggaaattaacagagtctacaaagaaatgtacaaaactgatctggagaaggacattatttcggacacatatggtgacttctgcaagctgatgtttgccctggcaaatgttagaagaccagaggatggctctgtcgttgattatgaactgattgaccaagatgcccgggatttctgtgatgctggagtgaagaggaaaagaactgatgttcccaagtggatcagcatgatgaccgagtagagcatgtcccacctccagaaagtatttgataggtacaagagctacagcccatcaagagagagcatcaagaaagaggttaaaggagacctggaaaatgctttcctgaacctggtccagtgcattcagaacaagcccctgtattttgctgattggctgtactactccatgaagggccagggggctcgagataaggtcctgatcagaatcatcgtctcccgcagtgaagtggacatgttgaaaattaggtctgaattcaagagaaagtatggcatgtccccgtactattacatccagcaagacactaagaacgactacccagaaagcactgctgtacctgtgtggtggagatgactgaagcccaacatagcttgagcttccagaaacgg

SEQ ID NO: 2971 - DNA, 1563 bp, Homo sapiens
attccagcaggaaaacaggatggaggaaggtacaaagcatgaatgagcctggcctgtccagcagtggcacatggagcggtgaagagtgaagatgtgggggaatgaggctgcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagaaaaaattagccgggcgtgggggcgggctcctgtagtcccagctactccggaggctgaggcaggagaatggcgtgaacccaggaggcggatgagccaagatcacgccactgcactccagcttgggcaacagagcgagactcgcggtggctcatgcctgtaatcccaacactttgggaggccaaggtgggcggatcatgaggtcaggagatcgtgaccatcctggctaatacagtgaaaccccgtctctactaaaaatacaaaaaaattagccaggcatggtggcgggcgcttgtagtgccagctactcgggaggctgaggcaagagaatggtgtgaacctgggaggc

SEQ ID NO: 2972 - DNA, 2692 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtaaaaaaaaaaaaaaaaaaaaaaaaaaaaaaaaaaaaaaaaaaaaaaaaaaaaaaaaaaaaaaaaaaa

SEQ ID NO: 2973 - DNA, 2534 bp, Homo sapiens
gacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcataccctcaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttg

SEQ ID NO: 2974 - DNA, 2584 bp, Homo sapiens
gtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggt

SEQ ID NO: 2975 - DNA, 2032 bp, Homo sapiens
gtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaaccttaaatcctgtagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaaga

SEQ ID NO: 2976 - DNA, 2095 bp, Homo sapiens
gtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaaccttaaatcctgtagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaaga

SEQ ID NO: 2977 - DNA, 10405 bp, Homo sapiens
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtct

SEQ ID NO: 2978 - DNA, 1795 bp, Homo sapiens
ggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggtcagccccgggccgcgcgggctcctcgcgttggtgccgagtcggggtcagggcgccgccattgacccggggaggacccggggaaccggagccccgtttacgcccctggggagggaactccccgtgtcccggacccgggcctggcagcgagacgcgcaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgaccccccgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttataga

SEQ ID NO: 2979 - DNA, 1795 bp, Homo sapiens; identical to SEQ ID NO: 2978

SEQ ID NO: 2980 - DNA, 1641 bp, Homo sapiens
ggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgaccccccgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttataga

SEQ ID NO: 2981 - DNA, 1648 bp, Homo sapiens
gagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtatccctgggcaaagccaccttctacaagcagctgccccaggacctggggacagcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttaaacaggtgacaggctgctttcgtgacttgatattggtgtcatagcatttggcctacattaaaagccacaatttcatggggaaaggacaaaatggagggtgactgaggtgctgacctcaatgcaaggctggtgaaccctgcagcgggccagctatggtgggaagcctggcatttggggtgctccttgcaacgtcttaagcaagcgacccccctgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttataaaaaaaaaaaaaaaaaaaa

SEQ ID NO: 2982 - DNA, 7236 bp, Homo sapiens
gcgggtagatcttgggccgggcagcagcagtcgcagagcggcgcggcggcggtggcggcagcaggcagcaggcatgaccatggcagcggcggcggtggtggcacgcggggccggggcgagggcagcgacagcggcggctttgcggggtggctgcgggaccgcggctcgggggcggccgtgtgcgggccccgcccggcccttgtgcactgcacccgggaccgccccggacatgaagcgctacctgtgggagcgctaccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatggttaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaacggttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccaggggaggaggaagatggccaccacaacttagccatgtccagccttctcttagatttcactcctgtgatgtttgtgcgactatttgggagtttgtatagtttgtttttttttttttgttttgttttgtttttttttagatgtctaagatgggaaagggcgaaggacattgaagctaaggaatagatatgacctagctaaccaagcttttctcatttctttctgttttgttttgttgagatggagttttgctcttattgcccaggctggagtgcagtggcacaatctcagctcactgcaacctctgcctcccgggttcaagcgattctcctgcctcagcctcccaagtagctgggattacaggcatgcactaccacacccagctaattttgtatttctagtagagatggggtttctccatggtggtcaggctggtctcgaactcctgacctcagataatctgcccgccttggcctcccaaattgctgggattacaggtgtgagccaccgcacctggcctgcttttttcatttctttctaggggcaatgcaagtggcatgtattccttttgttggagggaagaatccttaattgcacctgcatttgtagtatccttcaatgtaaagtgcatatttactgcactctctgagtgctatgggaatgtctgctgttattagttatggggctgctaatactgttttaattgcatatgctatatcaatacttctgttcagattagcctgatctagtattgctaaaactcattttaagcttttgcggtaacttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttttcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttacgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacatttttgggtatgaataatgagttttgtaatcaattcccagttagaagaatttcagtctctgggccattgagcttggcagtgttgagatctcccatgtgacagaagcctgacatctgggccaccaaggctcactgactgtgtaccttgcagactgtagacccatgtcgtggcggtaacggggccaaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaacgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtatca

SEQ ID NO: 2983 - DNA, 1702 bp, Homo sapiens
gcgggtagatcttgggccgggcagcagcagtcgcagagcggcgcggcggcggtggcggcagcaggcagcaggcatgaccatggcagcggcggcggtggtggcacgcggggccggggcgagggcagcgacagcggcggctttgcggggtggctgcgggaccgcggctcgggggcggccgtgtgcgggccccgcccggcccttgtgcactgcacccgggaccgccccggacatgaagcgctacctgtgggagcgctaccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggtagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaag

SEQ ID NO: 2984 - DNA, 7028 bp, Homo sapiens
ccggacatgaagcgctacctgtgggagcgctacccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatgattaagacaggagctagcagcccacccctccagcctttccccccatgcagggctgaaaggcaagcttcacattggaactctgattttgcctttttgtttactgaggtcctggaacatcaggtttcctgggataggtagaccacttgatgccatgtctgtattctagcaggtcaagcttgaaaccgttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccaggggaggaggaagatggccaccacaacttagccatgtccagccttctcttagatttcactcctgtgatgtttgtgcgactatttgggagtttgtatagtttgtttttttttttttgttttgttttgtttttttttagatgtctaagatgggaaagggcgaaggacattgaagctaaggaatagatatgacctagctaaccaagcttttctcatttctttctgttttgttttgttgagatggagttttgctcttattgcccaggctggagtgcagtggcacaatctcagctcactgcaacctctgcctcccgggttcaagcgattctcctgcctcagcctcccaagtagctgggattacaggcatgcactaccacacccagctaattttgtatttctagtagagatggggtttctccatggtggtcaggctggtctcgaactcctgacctcagataatctgcccgccttggcctcccaaattgctgggattacaggtgtgagccaccgcacctggcctgcttttttcatttctttctaggggcaatgcaagtggcatgtattccttttgttggagggaagaatccttaattgcacctggatttgtagtatccttcaatgtaaagtgcatatttactgcactctctgagtgctatgggaatgtctgctgttattagttatggggctgctaatactgttttaattgcatatgctatatcaatacttctgttcagattagcctgatctagtattgctaaaactcattttaagcttttgcggtaacttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttttcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttacgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacattttctgggtatgaataatgagttttgtaatcaattcccagttagaagaatttcagtctctgggccattgagcttggcagtgttgagatctcccatgtgacagaagcctggcatctgggccaccaaggctcactgactgtgtaccttgcagactgtagacccatgtcgtggcggtaacggggccaaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaacgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaaggtctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtaaaaaaaaaaaaaaaaaa

SEQ ID NO: 2985 - DNA, 7236 bp, Homo sapiens
gcgggtagatcttgggccgggcagcagcagtcgcagagcggcgcggcggcggtggcggcagcaggcagcaggcatgaccatggcagcggcggcggtggtggcacgcggggccggggcgagggcagcgacagcggcggctttgcggggtggctgcgggaccgcggctcgggggcggccgtgtgcgggccccgcccggcccttgtgcactgcacccgggaccgccccggacatgaagcgctacctgtgggagcgctaccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggtagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatggttaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaacggttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccaggggaggaggaagatggccaccacaacttagccatgtccagccttctcttagatttcactcctgtgatgtttgtgcgactatttgggagtttgtatagtttgtttttttttttttgttttgttttgtttttttttagatgtctaagatgggaaagggcgaaggacattgaagctaaggaatagatatgacctagctaaccaagcttttctcatttctttctgttttgttttgttgagatggagttttgctcttattgcccaggctggagtgcagtggcacaatctcagctcactgcaacctctgcctcccgggttcaagcgattctcctgcctcagcctcccaagtagctgggattacaggcatgcactaccacacccagctaattttgtatttctagtagagatggggtttctccatggtggtcaggctggtctcgaactcctgacctcagataatctgcccgccttggcctcccaaattgctgggattacaggtgtgagccaccgcacctggcctgcttttttcatttctttctaggggcaatgcaagtggcatgtattccttttgttggagggaagaatccttaattgcacctgcatttgtagtatccttcaatgtaaagtgcatatttactgcactctctgagtgctatgggaatgtctgctgttattagttatggggctgctaatactgttttaattgcatatgctatatcaatacttctgttcagattagcctgatctagtattgctaaaactcattttaagcttttgcggtaacttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttttcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttacgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacatttttgggtatgaataatgagttttgtaatcaattcccagttagaagaatttcagtctctgggccattgagcttggcagtgttgagatctcccatgtgacagaagcctgacatctgggccaccaaggctcactgactgtgtaccttgcagactgtagacccatgtcgtggcggtaacggggccaaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaacgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtatca

SEQ ID NO: 2986 - DNA, 3171 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggagaggaacgcgttgtggtgatcagcagctcggaagactcagatgccgaaaactcgtgcatggagcccatggagaccgccgagccacagtcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaa

SEQ ID NO: 2987 - DNA, 1851 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccaaaaaaaaaaaaaaaaa

SEQ ID NO: 2988 - DNA, 1797 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaa

SEQ ID NO: 2989 - DNA, 3088 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaa

SEQ ID NO: 2990 - DNA, 1395 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctg

SEQ ID NO: 2991 - DNA, 3631 bp, Homo sapiens
gggcgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgttcctgcttccaaagcctgaccttccaaagcttggggaatgtcctcggcttagaaccagtcttccgccttcagatctgctcttccaagaggagagctccctggagagccacagtactgtctctttaggccacccctcccatcgttacagcagggtcatttatggcagccactagaacctcgtttttagagccttccattgtcccggggccagggaaatgtcctttgtcctaaacttactcgagctgccttctctaagaaacctctactgtctcctttaataaaaggacaccccctttccaccaagctt

SEQ ID NO: 2992 - DNA, 3736 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaaaaaaaaaaaaaaaaaaaaaaaa

SEQ ID NO: 2993 - DNA, 2944 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaa

SEQ ID NO: 2994 - DNA, 2254 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccaaaaaaaaaaaaaaaaa

SEQ ID NO: 2995 - DNA, 2110 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccaaaaaaaaaaaaaaaaa

SEQ ID NO: 2996 - DNA, 3751 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaaaaaaaaaaaaaaaaaaaaaaaa

SEQ ID NO: 2997 - DNA, 3073 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcaaaaaaaaaaaaaaaa

SEQ ID NO: 2998 - DNA, 1806 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggag

SEQ ID NO: 2999 - DNA, 1665 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtg

SEQ ID NO: 3000 - DNA, 8295 bp, Homo sapiens
cttcaacaggtttgtctcagcgcagggaccctccgggcctgctttggaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatct

SEQ ID NO: 3001 - DNA, 8295 bp, Homo sapiens; identical to SEQ ID NO: 3000

SEQ ID NO: 3002 - DNA, 8295 bp, Homo sapiens; identical to SEQ ID NO: 3000

SEQ ID NO: 3003 - DNA, 8521 bp, Homo sapiens
tccctcggccgcctctcctcccggagcgagcgcgcagccctgcgcagcagcgcccactggtcccgtcctgtgagccccggccccagccgcggacagacccgcggagtcgcctcccggcccacccgcccggccgccgaggagcgggaggaggacgggaccccggcgcccccaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggattttacagcgaaacccttacatgagtaattgaaatgaaattaaatgagattacagcataatgaagaagaaaactagaatctaacagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatct

SEQ ID NO: 3004 - DNA, 7561 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaatgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaacacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttatttttttttttaatttatagagcatttcggggggggtgggg

SEQ ID NO: 3005 - DNA, 4242 bp, Homo sapiens
ttttacagacactgctgcagtaaataatctatgcatatttcgtatcctaaatatgcaagaatgtatatgtaggatcaattccccaaagtaggatcataaaatcagaaggtaccacatttataattttcatgggtactgcccatttaccttctgtaggagctgtagtctgttacactcctgtctacagagaatgagctcactgacaaatatatcatcacacttggatttttgccaactaatagatgacacattacagtatctccatgaagcatcttttcatgtttaagacccatttgcatttcctgctttctgaatgttttcttcatgccagtttctgtgttggtttgttggtttttttcttttctttctttctttctttctttcttttatttatgactgtcatagctgaaaaagataactcaaccaaaatatgtagatgtaagtagaagtgtaccattggctccatttaccaaatcacaattctcaatgtatatttttagttttgcaaggtttttgttgaaatttggctatttcaagtttcaccttctttaacgttaattagttattttaaccacatagggtgccacgtttttatactttttgagtgtaaatgtcccacggtgagaactcttacaggcgatacatacattgtattcacatagcaatgagaagtcattttcaaaatgtgctcttcatggcagtttcccattcatcataaaaacatttatctttaccccgagatagcagattaggtatttattttttggactgtatctgaatatgtcccactcagatatcccaggctgcctccaggggactttccctgactaaactctcctgcctgtcttcctgtagcatttcatttgttttatcattcataaagaacttaataatgtagttgaacagatttatagaaaacgggtttttgtgacttggatctccccagtgaaattgagggctccttaaggggcatgggccatattttgactctgtgctccctttagtgtatgagcagaacagaatagggcttggggtgatggtgggaaggccgccatgggctgacctggctcatcccctacatggcttcacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcaatgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgttgtctgttggcatgcttaaagcacatgtccattaaaattcattttgttcctttt

SEQ ID NO: 3006 - DNA, 8295 bp, Homo sapiens; identical to SEQ ID NO: 3000

SEQ ID NO: 3007 - DNA, 8295 bp, Homo sapiens; identical to SEQ ID NO: 3000

SEQ ID NO: 3008 - DNA, 9074 bp, Homo sapiens
ggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaattagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcaatgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgttgtctgttggcatgcttaaagcacatgtccattaaaattcattttgttcctttt

SEQ ID NO: 3009 - DNA, 14760 bp, Homo sapiens
ccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggtccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagctgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 3010 - DNA, 14760 bp, Homo sapiens; identical to SEQ ID NO: 3009

SEQ ID NO: 3011 - DNA, 14760 bp, Homo sapiens; identical to SEQ ID NO: 3009

SEQ ID NO: 3012 - DNA, 1669 bp, Homo sapiens
actttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 3013 - DNA, 1669 bp, Homo sapiens; identical to SEQ ID NO: 3012

SEQ ID NO: 3014 - DNA, 1560 bp, Homo sapiens
actttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagagtcttgttatgtcgcccaggatggagtgtagtgacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 3015 - DNA, 4079 bp, Homo sapiens
tggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatggttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagaagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 3016 - DNA, 1669 bp, Homo sapiens; identical to SEQ ID NO: 3012

SEQ ID NO: 3017 - DNA, 1671 bp, Homo sapiens
actttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 3018 - DNA, 1385 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttggctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgaaaaaaaaaaaaaaaaaaaaaaaaaaaaaa

SEQ ID NO: 3019 - DNA, 3748 bp, Homo sapiens
ctctgtggggactaggttcagaagatgtcatctcccccatagactagcttcccagagaatgtcacctgcaaactagaatgatgctagtctcagcttaactgtgcaaagagaaaaccagaacgcgctccccaggaacaaggttcattcacagttgtcagaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaaatagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgttactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcggtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcag

SEQ ID NO: 3020 - DNA, 3744 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatctgaggaaactgaaacccagagaagttttgtaataacttgcccaggattacacaaagaagtgatggagcctactcttaaccattagggtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaaatagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgttactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcggtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcag

SEQ ID NO: 3021 - DNA, 3748 bp, Homo sapiens; identical to SEQ ID NO: 3019

SEQ ID NO: 3022 - DNA, 3312 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacaggtgcggctggctgggggtggctgcaggaaccgggctcagagaggcgtcccggacgccacaagcctcccggtgtcagcgccctgtcctcccctgcagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 3023 - DNA, 2238 bp, Homo sapiens
atgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctag

SEQ ID NO: 3024 - DNA, 3216 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 3025 - DNA, 3216 bp, Homo sapiens; identical to SEQ ID NO: 3024

SEQ ID NO: 3026 - DNA, 3357 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaaggtggggcacgaggcactgcccagctctgggcaaggatgtcccaggcctttcagagaagcagcaggcagcagggagcttgaaggtgggagagggggactatggggacccatgtggactccctttctgtctgtctgtccctgtcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctcc

SEQ ID NO: 3027 - DNA, 2281 bp, Homo sapiens
cggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtactgtatgcccccccgcctctgcccccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtag

SEQ ID NO: 3028 - DNA, 2788 bp, Homo sapiens
cggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 3029 - DNA, 3818 bp, Homo sapiens
gagccacaactttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaa

SEQ ID NO: 3030 - DNA, 3693 bp, Homo sapiens
acccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcattgtggctgctcagtgaaggaggtcttgggcagggcggctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggtcatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgcacgttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggttttttttttttttaatctgcatttattagtattataataaaagcattttgatcgg

SEQ ID NO: 3031 - DNA, 3822 bp, Homo sapiens
gagccacaactttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggcaagttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaa

SEQ ID NO: 3032 - DNA, 769 bp, Homo sapiens
agggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttc

SEQ ID NO: 3033 - DNA, 544 bp, Homo sapiens
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagat

SEQ ID NO: 3034 - DNA, 8434 bp, Homo sapiens
tccctcggccgcctctcctcccggagcgagcgcgcagccctgcgcagcagcgcccactggtcccgtcctgtgagccccggccccagccgcggacagacccgcggagtcgcctcccggcccacccgcccggccgccgaggagcgggaggaggacgggaccccggcgcccccaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatct

SEQ ID NO: 3035 - DNA, 2469 bp, Homo sapiens
agattgtaacagatctcaatagtttttttcatattgattacatgttgtaataattttatacatattatgtgaaatacactattaaagttaatttcacctatttatttttactctttttaatgtggctactggaaaagtcaaagttgcaagtgtggctcacattacatttacattggacagggctaatttagagtagacgatagactggttatgcaggtagccatcaccagagggcagcagtgccaagaggtaaggccatatgactgcccggcacctcctggtcaacgtgtactaactcatggtaccctgtgcagttctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatct

SEQ ID NO: 3036 - DNA, 4525 bp, Homo sapiens
gcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggc

SEQ ID NO: 3037 - DNA, 4849 bp, Homo sapiens
atggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctaca

SEQ ID NO: 3038 - DNA, 4513 bp, Homo sapiens
cggcgggtccgaggccggcgtgcgcggaggctgggcgggcagcccgagcggtgtccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatc

SEQ ID NO: 3039 - DNA, 5031 bp, Homo sapiens
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgacctgtcttcagtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaagag

SEQ ID NO: 3040 - DNA, 4513 bp, Homo sapiens
gcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggc

SEQ ID NO: 3041 - DNA, 3914 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcaagaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgcccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaa

SEQ ID NO: 3042 - DNA, 3914 bp, Homo sapiens; identical to SEQ ID NO: 3041

SEQ ID NO: 3043 - DNA, 3914 bp, Homo sapiens; identical to SEQ ID NO: 3041

SEQ ID NO: 3044 - DNA, 1444 bp, Homo sapiens
gagccgagttattatctgcctctccgataggatgcctctttgtcttcacctgccattcccgctgtttcgtgaagaatcctctgtaaagggaaatttgttcaggcgactgctgtggccaccctctgcctcctccggcctctgcccctgggaggtccccgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaatat

SEQ ID NO: 3045 - DNA, 1227 bp, Homo sapiens
aacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaacactcccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattgggatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagcc

SEQ ID NO: 3046 - DNA, 1273 bp, Homo sapiens
ccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaaaaaaaaaaaaaaaaaaaa

SEQ ID NO: 3047 - DNA, 2587 bp, Homo sapiens
cgcgcctgcccgcggctggggaaccaagggcctggaggggaaacagctccctgctgcgttgttttgggctccgtgagccgaaagggggaggggagacgaaggagaagcaaacactgcgcaccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaa

SEQ ID NO: 3048 - DNA, 5237 bp, Homo sapiens
gcgggaggaagcgggaggaactccgtcgtcctccgcgcgcgcctgcccgcggctggggaaccaagggcctggaggggaaacagctccctgctgcgttgttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattc

SEQ ID NO: 3049 - DNA, 4058 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggcaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggctggtctcgaactcctggcctcaagtgatcctcccgcctcggtctcccaaagtgctgggattacaggtgtgagccattgtaccctgccaataattgtgtatatgtacgggatataatgtgatgttctgatctatgtatagataaagattaaa

SEQ ID NO: 3050 - DNA, 1623 bp, Homo sapiens
agtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattg

SEQ ID NO: 3051 - DNA, 621 bp, Homo sapiens
ttgttgcagctacctgcacttctagataacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaa

SEQ ID NO: 3052 - DNA, 2797 bp, Homo sapiens
attcctgaacaggccaagcactgggtgaaactactcaggattcagaagcagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgg

SEQ ID NO: 3053 - DNA, 2797 bp, Homo sapiens; identical to SEQ ID NO: 3052

SEQ ID NO: 3054 - DNA, 2821 bp, Homo sapiens
aaaggttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcaaaaaaaaaaaaaaaaagtttcca

SEQ ID NO: 3055 - DNA, 2797 bp, Homo sapiens; identical to SEQ ID NO: 3052

SEQ ID NO: 3056 - DNA, 2797 bp, Homo sapiens; identical to SEQ ID NO: 3052

SEQ ID NO: 3057 - DNA, 2123 bp, Homo sapiens
gagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttaca

SEQ ID NO: 3058 - DNA, 2275 bp, Homo sapiens
tggtggcgggcgcctgtagtcccagccacccgggaggctgaggcaggagaatggtgtgaacccgggaggcggagcttgcagtgagctgagatcgtgccactgcactccacgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttaagaaaactttaaaaaaactcccattaaaaacaaaacatctttgtgttttgaacaaaggaattttcaatatttgattggtattctgttctgaagtctaagatatttttcagcctataaagccccctgttttatgccct

SEQ ID NO: 3059 - DNA, 2334 bp, Homo sapiens
gggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggatacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttcttttttttttttttaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgttttttttttttttttttttaaagcgtgtgtgaacaaatggaaataaagcagggactgtgaacattaaaaaaaaaaaaaaaaaaaaaaaaaaaaaaa

SEQ ID NO: 3060 - DNA, 2275 bp, Homo sapiens; identical to SEQ ID NO: 3058

SEQ ID NO: 3061 - DNA, 2275 bp, Homo sapiens; identical to SEQ ID NO: 3058

SEQ ID NO: 3062 - DNA, 2799 bp, Homo sapiens
cgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaata

SEQ ID NO: 3063 - DNA, 2764 bp, Homo sapiens
ccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaaaaaaaaaaaa

SEQ ID NO: 3064 - DNA, 5199 bp, Homo sapiens
gcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattac

SEQ ID NO: 3065 - DNA, 5047 bp, Homo sapiens
ccgttgctgtcgccgttgctgtcgggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcccccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattac

SEQ ID NO: 3066 - DNA, 2159 bp, Homo sapiens
cggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagtctcattttatcactgcgtttgtatctattactaaaatgtattttttgacctcttactgattcattgttggtatgtacaaactgttgacttgtaaaatcaataaagtcttagttgg

SEQ ID NO: 3067 - DNA, 4062 bp, Homo sapiens
tggcggacaaccgggcctacgagtagctaaacggcaggggggacccaaacaggggagaagggtgaacatcttaactcggttctgaaacagggagtcttgggttacctcggaaaaggcgaagttcctcgagggaaaaggaagggagcggctgggggggcggttggggggggcccggaaaatggatcccaggcccaggcggggccctagcggggcctgagccggggaacgactgcgtctccgaagaaaggtgccaaagaaggctaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatgctctttttctaaccgtcaccccctctttttttttttggtattgcctgacaacatgatgaatcacctccatgtttataagttttatgttttcagctgggcacagtggctcacgcctgtaatcccagcactttgggaggccgaggcaggcggatcatgaggtcaggagatcgagactatcctggctaacacagtgaaatcccatctctactaaaaatacaaaaaatagttagctgggtgtggtggtacgcacctgtaatcccagctactcgggtggctgaggcaggagaatcgcttgaacccaggaagtggaggttgcagtgagccaagatcatgccactgcactccagcctgggcaacagagcgagacttgtctcaaaaaataataatgggctgggtgcggtggctcacacctgtaatcccagtactttgggaggctgaggcgggcagatcacgaggtcaggagatcgagaccatcctggctaacacggtgaaaccccgtctctact

SEQ ID NO: 3068 - DNA, 4062 bp, Homo sapiens; identical to SEQ ID NO: 3067

SEQ ID NO: 3069 - DNA, 1847 bp, Homo sapiens
tggcggacaaccgggcctacgagtagctaaacggcaggggggacccaaacaggggagaagggtgaacatcttaactcggttctgaaacagggagtcttgggttacctcggaaaaggcgaagttcctcgagggaaaaggaagggagcggctgggggggcggttggggggggcccggaaaatggatcccaggcccaggcggggccctagcggggcctgagccggggaacgactgcgtctccgaagaaaggtgccaaagaaggctaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaaggtgttaagagcagctaatcaaatggataagatacaattt

SEQ ID NO: 3070 - DNA, 1847 bp, Homo sapiens; identical to SEQ ID NO: 3069

SEQ ID NO: 3071 - DNA, 1644 bp, Homo sapiens
tccccgcccctcgcgccttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaatttttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctgtaccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttact

SEQ ID NO: 3072 - DNA, 1644 bp, Homo sapiens; identical to SEQ ID NO: 3071

SEQ ID NO: 3073 - DNA, 1648 bp, Homo sapiens
catgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgggtcagagaaaaaaaaaaaaaaaaaaaaaa

SEQ ID NO: 3074 - DNA, 3822 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacgtatgacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccaggcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactctcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcaga

SEQ ID NO: 3075 - DNA, 1986 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagg

SEQ ID NO: 3076 - DNA, 3840 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactctcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgtggaggtaagtattgctattatctctatggtatgtctgtagactttgagattcagacatctgataatggcagaaccagagcctgagtccaagtctggctccacaccccagcctcttaacactgtgccaattgctttgacactttgctggggagagatgaaatgatctcaaaggcactcatgatacagaa

SEQ ID NO: 3077 - DNA, 885 bp, Homo sapiens
cttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtaaaaaaaaaaaaaaaaaa

SEQ ID NO: 3078 - DNA, 3935 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactctcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgtggaggtaagtattgctattatctctatggtatgtctgtagactttgagattcagacatctgataatggcagaaccagagcctgagtccaagtctggctccacaccccagcctcttaacactgtgccaattgctttgacactttgctggggagagatgaaatgatctcaaaggcactcatgatacagaa

SEQ ID NO: 3079 - DNA, 4162 bp, Homo sapiens
cgcaggcgcggtccatcccgcccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 3080 - DNA, 3188 bp, Homo sapiens
cgcaggcgcggtccatcccgcccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtggaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctgggggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 3081 - DNA, 4103 bp, Homo sapiens
cccacgcgtccgctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaaccttaaaaaaaaaaaaaaa

SEQ ID NO: 3082 - DNA, 4103 bp, Homo sapiens; identical to SEQ ID NO: 3081

SEQ ID NO: 3083 - DNA, 4162 bp, Homo sapiens; identical to SEQ ID NO: 3079

SEQ ID NO: 3084 - DNA, 3170 bp, Homo sapiens
gccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcagcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaactata

SEQ ID NO: 3085 - DNA, 2226 bp, Homo sapiens
gggaggggcgtgcgccgagagggagctcagatcgagcggggcgcgggtggagaagctgcggcagcgcggcccgtaggaaggtgctgtccgaacgatcgggataggagcggtccctgcgcttgctgctgggaagtgggtaagcgccgctcccaggctggccccgccgcccgggcgggatgctcccagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggttacaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattaaacttcaaactctttactttataaattgtccataggccacactttaatatcacattataaaggg

SEQ ID NO: 3086 - DNA, 1843 bp, Homo sapiens
ataatgtcatcaacattgatttgaagtgatcagctgtggattggtccattgatttttccaacatactccacaaatccccaaaattccaaagagatgcttccaaagcagggtttggggcctcccaccatcactcccattgatactgcaatcagattattcccaactcttcctgcagtcctagtgttagaatacctatagtactatccccttatgtgtggttttgctttccacgggttcagttatctgcggtcacttgcagtctgaaagtactagaaggaaaattccagaaataaacaattcataagttttaaattgtgtgctgcttcatcctgcctgggacatttatcattcctttgtccagcatatccacattccatatgctacttagtcacttagtaacttttggcaatcagattcaaaaaacaggtatgtgtgtaagtatatatagggttcagtactctccacagtttcagacatctactgggggtcttggaatgtatccctgcagataaggggggaactactgtaatgtcatataactcctttcttatttctgtttttttgttgttgctattgttacagtgtcccggctcgtgaccatttccaaggatccatatgaagcatgtgatggtgcccatgctgttgttatttgcactgagtgggacatgtttaaggtaaggtaacagaaaagatactaaggaaaattctagaggtgttccactatcagctggggttgagtatgtgttcatgtatgtgtttttttgtttttttgtttttttttttgagatggagtctcgctctgtcgccctggctggagtgcagtggcgcaatctcggctcactgcaagctctgcctcctgggttcacgccattctcctgcctcagcttcctgagtagctgggactacaagctcctgccaccacgcccaactaattttttgtatttttagtagagacggggtttcaccatgttggccaggatggtctcgatctcctgacctcgtgatccacccatcttggcctcccaaagtgctgggattacaggcatgagccactccgcccggcccacgtatgtgttttaattgttcctgtggtttgtctttacaggaattggattatgaacgcattcataaaaaaatgctaaagccagcctttatcttcgatggacggcgtgtcctggatgggctccacaatgaactacaaaccattggcttccaggtaatcatgatcctggattgttttttttctttttgtttggtctttagtgtttgattcaacaactggggactataatctagtcaagttgacatcaaaagaccatcacagcaggtcagaatatgtttggctaattaagatgataccttctttctagggaagttcttttggggaaccaaatcaatatcagaagtttatttcaacaattaggaaagtgctcatttgctttttaaacccattgtgtgggttttagaattttcttattttctttagcagtaacgtaactctggggcaacatgtcagttctttaggaagtccctatgggatttttctgactactctacttctctacttcctccctaaatttgcgatctaaaggtagagaaagaaagaggtcttggtcaatcagcaggtgttcatcctataccttctgagtactcagcactgtgccagtgctgtgaggggtctgaatgaaacatatgggagtttcaatggtactggccctcttctgattcaaagtttgtcaactggccaggcatagtggttcacacctgtaatcccagcactttgggaggctgtggaggtagaccacttaaggccaggagttcgagaccagcctagccaacatgg

SEQ ID NO: 3087 - DNA, 4782 bp, Homo sapiens
aagtttttaatgatacctgccgctcaggtggcctaggtggtagtcatgccttgcttctacttacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagttcgagcttcaccttatggaccgtgatttactgcaaattatttttagcttcagtaaagctgggtatctcagtatgtctcagaaattttggaaaaagtttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatgtttggagcgagataacagaattattgtacaaggatggacgttattgccaggagcctcgaggaccgacggaagctgttggcaattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagcgtaagaatttagactttcaaaaaactgtgcaacttacatcatctgaattggagtcaacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaactatctaggccttgtaagagtattggcaaagcatggcaagctccaagatgctattaagattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagttttttctctgggaaaaatcgatagtgttttcttcaatgctgctgctgtgtgaagccatacttttcaggattcttccctaattggctctttggtttccctgctctgtttcatttatttcattaaaatgttattcctttatttaagattcacttattagtctgctgtttctctgaaaaattttagagctaggtatagtgaccgtgaacttctaacgcataatatctgtgatacagccattccgtacatgtgtgagtctgcataactttcgaactttcgaactttgttaaatgttggcactaggagtcatcagatctaggattcatcattttccagtgagaagcagagacccaaaggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttcttactttatactcatatcctgaaaagatgtgatttcatctatgaaggggtaaaatattggtttgtatttaattgtttgaaataaaagtgatccctataaaaaaaaaaaaaaaaaaaaaaaaaaaaaaaaaaaaaaaaaaaaaaaaaaaaaaaaaaaaaaaa

SEQ ID NO: 3088 - DNA, 5687 bp, Homo sapiens
acatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatcttttttttt

SEQ ID NO: 3089 - DNA, 2234 bp, Homo sapiens
gagacagaggctctgtcgcccaggctggagtgcagtggcgcgatcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaa

SEQ ID NO: 3090 - DNA, 2366 bp, Homo sapiens
aagatgagtctagttaataatctacaattattggttaaagaagtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtatag

SEQ ID NO: 3091 - DNA, 2068 bp, Homo sapiens
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacgttcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaacaaaaaaaaaaaaaaaaaaaaaaaaaaaaa

SEQ ID NO: 3092 - DNA, 2151 bp, Homo sapiens
cttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgtattcctttttgtagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3093 - DNA, 2166 bp, Homo sapiens
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcataactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3094 - DNA, 2366 bp, Homo sapiens; identical to SEQ ID NO: 3090

SEQ ID NO: 3095 - DNA, 2148 bp, Homo sapiens
tgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctcccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3096 - DNA, 2134 bp, Homo sapiens
cacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaagttgtagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3097 - DNA, 2050 bp, Homo sapiens
gcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaagtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagactctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3098 - DNA, 2147 bp, Homo sapiens
gtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3099 - DNA, 2227 bp, Homo sapiens
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtatag

SEQ ID NO: 3100 - DNA, 1642 bp, Homo sapiens
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3101 - DNA, 2366 bp, Homo sapiens; identical to SEQ ID NO: 3090

SEQ ID NO: 3102 - DNA, 2084 bp, Homo sapiens
aaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactattggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 3103 - DNA, 594 bp, Homo sapiens
cgcggcccggcactcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggcagcctgt

SEQ ID NO: 3104 - DNA, 594 bp, Homo sapiens; identical to SEQ ID NO: 3103

SEQ ID NO: 3105 - DNA, 3576 bp, Homo sapiens
tgagccgccagtatggccgggctatggcggcgagcactggctacgtgcgactgtggggagcggcgcggtgctgggtgctgcggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccacctgccagggacgaggccgccgtcagcccggccctgactcccatcccaccccgcccctcggccggcagcgcccacctacccttttcttgataaatttgagggcccgtttgtccttggagaccttcagtaactccatggcgcgccgctcgtacggggcaaagccacacacctcccgaatcatgtcccgcacgaacttggtgt

SEQ ID NO: 3106 - DNA, 3513 bp, Homo sapiens
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccac

SEQ ID NO: 3107 - DNA, 3513 bp, Homo sapiens; identical to SEQ ID NO: 3106

SEQ ID NO: 3108 - DNA, 3137 bp, Homo sapiens
gggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtaaaaaaaaaaaaaaaaaaaaaaaaaaaaaaaaaaaaaaaaaaaaaaaaaaaaaaa

SEQ ID NO: 3109 - DNA, 1083 bp, Homo sapiens
tccaatcacaggggctcatcctcagggactactttgcaatcggcgcagagcgcagtgagaagagcttgaaaaaaacctctggtatcgggaagtgtagttcaacacttgaaggaaatgctttggagattgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttactgtgcagcagcgtggcgctgctgtcatcaaggctcgaaaactatccagtgccatgtctgctgcaaaagccatctgtgaccacgtcagggacatctggtttggaaccccagag

SEQ ID NO: 3110 - DNA, 1515 bp, Homo sapiens
tccaatcacaggggctcatcctcagggactactttgcaatcggcgcagagcgcagtgagaagagcttgaaaaaaacctctggtatcgggaagtgtagttcaacacttgaaggaaatgctttggagattgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaa

SEQ ID NO: 3111 - DNA, 1213 bp, Homo sapiens
atgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatga

SEQ ID NO: 3112 - DNA, 1219 bp, Homo sapiens
tgactctctgaggctcattttgcagttgttgaaattgtccccgcatctttttcattacagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaataataataatgctatacttaaattacttgtgaaaaacaacacattttaaagattacgtgcttcttggtacaggtttgtgaatgacagtttatcgtcatgctgttagtgtgcattctaaataaatatatattcaaat

SEQ ID NO: 3113 - DNA, 2117 bp, Homo sapiens
ggcagtggctccttgcacagcagctgcacgcgccgtggctccggatctcttcgtctttgcagcgtagcccgagtcggtcagcgccggaggtgagcgccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcagtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccatggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaccgactctggccctggcccttacttgcttctctagctctctaggcctctccagtttgcacctgtccccaccctccactcagctgtcctgcagcaaacactccaccctccaccttccattttcccccactactgcag

SEQ ID NO: 3114 - DNA, 2392 bp, Homo sapiens
agcgggataaccttgaggctgaggcagtggctccttgcacagcagctgcacgcgccgtggctccggatctcttcgtctttgcagcgtagcccgagtcggtcagcgccggagatgactcaacctttcaattattctgcttttgagagaattatcttcgctgggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacct

SEQ ID NO: 3115 - DNA, 2332 bp, Homo sapiens
gcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaaaaaaaaaaaaaaaaaaaaaaaaaaaaaa

SEQ ID NO: 3116 - DNA, 2392 bp, Homo sapiens; identical to SEQ ID NO: 3114

SEQ ID NO: 3117 - DNA, 5282 bp, Homo sapiens
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtat

SEQ ID NO: 3118 - DNA, 5282 bp, Homo sapiens; identical to SEQ ID NO: 3117

SEQ ID NO: 3119 - DNA, 4994 bp, Homo sapiens
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaacctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttttcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaa

SEQ ID NO: 3120 - DNA, 4994 bp, Homo sapiens; identical to SEQ ID NO: 3119

SEQ ID NO: 3121 - DNA, 5282 bp, Homo sapiens; identical to SEQ ID NO: 3117

SEQ ID NO: 3122 - DNA, 700 bp, Homo sapiens
gggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcagatcaagcaagagacaggctccttagcaaaaatatgctgtcatgtcaggaggtgagacctggacacacagaagaatcaagattctctcagatctgagcccttcatttttcagatgaagatttttttcagtgtgtctgagacagccacagagttacagggctgagcatctgccatgtgacagtcattgga

SEQ ID NO: 3123 - DNA, 1518 bp, Homo sapiens
ggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaaca

SEQ ID NO: 3124 - DNA, 2584 bp, Homo sapiens
gggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 3125 - DNA, 2217 bp, Homo sapiens
ccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatggaagctacatagtgtctcactttccaagatcattctacaagatgtcagtgcac

SEQ ID NO: 3126 - DNA, 2361 bp, Homo sapiens
ccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccac

SEQ ID NO: 3127 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 3128 - DNA, 6358 bp, Homo sapiens
ccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 3129 - DNA, 2317 bp, Homo sapiens
ctcccagggagggagggcggtcgccccgacgcgcaccgcgattcgccccaagggccctgcgcaggacgctgacgcgaagactcggaggcggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaa

SEQ ID NO: 3130 - DNA, 2317 bp, Homo sapiens; identical to SEQ ID NO: 3129

SEQ ID NO: 3131 - DNA, 2226 bp, Homo sapiens
cacgccctgctgccgccccgcagaaatgctttgtttacccacagtcttttgccagataagaccagtgtccagggtactggctcctcatctcacttaggcttatgccaaagataattttggtgcagatgcctgagccttaatgcttcaaggtgtagaccttttagcccatgctgtagccgttacaatggggccaaagggaagaacagtgattattgagcagacagagctggggaagtcctaaagtaacaaaagatagtgtgactgttgcaaagtcaattgacttaaaggataaatataaaaatactggagcaaaacttgttcaagatgttgccaataacacaaatgaagaggctgtggatggcactaccactgttactgcactggcacgctctattgccaaggaaggcttcgagaagattagcaaaggggctaatccggtggaaatcaggagaggtgtgatgttagctgttgatgctataatcgctgaaccaaaaaagcagtctaaacctgtgaccacccctgaagaaattgcacgggttgctacaatttctgcaaatggagacaaagaaattggcaatatcatttctgatgcaatgaaaaaggttggaagcaagggtatcatcacagtaaataatgggaaaagtaccgaatgatgaattagaaattatcgaaggcatgaagtttgattgaggctatatttctccatacttaattaatacatcaaaaggtcagaaatgtgaattccaggatgcctatgttctgctgagtgaaaagaaaatttctagtgtccagtccattgcacctgctcttgaaattgccaatgcttactgtaagccttggtcataattgctgaagacgttaatggagaagctctaagtacactcgtcttgaataggctaaaggttggtcttcaggttgtggcagtcaaggatccagggtttggtgacaatagaaacaaccagcttaaagatatggctattgctactggtggtgcagtgtttgcagaagaggggttgaccctaaatcttgaagacgttcagcctcatgacttaggaaaagttggagaggtcattgtgaccaaagacgatgccatgcttttaaaaggaaaaggtgacaaggctcaaattgaaaaatgtgttcaagaaatcattgagcagttagatgtcacaactagtgaatatgaaaaggaaaaactgaatgaacactggcaaaactttcagatggagtagctgtgctgaaggttggtgggacaagtgatgctgaagtgaatgaaaagcaagacagagttacagatgcccttaatgctacaagagctgctgttgaagaaggcattgttttgagagggggtcgtgccctgcttcggtgcattccagccttggactcactgactccagttaatgaagatcacaacattggtatagaaattattaaaaaaacactcaaatttccagcaatgaccattgctaagaatgcaggtgttgaagtatctttgatagttgagaaaattatgcaaagttcctcagaagttggttatgatgctatgggcagagattttgtgaatatggtggaaaaaggaattatcgacacaacaaagtttgtgagaactgctttattggatgcttctggtgtggcctctctcttaactacagcagaagttttagtcacagaaattcctaaagaagagaaggatcctggaatgggtgcaatggatggaatgggaggtggtatgggaggtggtatgttctaactcctagaagagtgctttacctttattaatgaactgtgacaggaagcccaaggcagtgttccttaccaataacttcagagaagtcagttggagaaaatgaagaaaaggctggctgatgttaaagaaatcactaaaaccatcagttactggtttcagttgacaaaatatataatggtttactgctgtcattgtccatgcatacagataatttattttgtatttttgaataaaaagtcatttgtacattcctgatactggataaaagagccatgtaccaatgtactgctttcaacttaaatcattgaggcattttcactactattctgttgaaatcaggattttagttcttgccaccaccagatgagaagttaaacagcctttctgtggagagtgagaataattgtgtacaaagtagagaaatgtccaattatgtgacaatctttgtgtaacaaaaatttgtttaaagttaaaaaaacaaa

SEQ ID NO: 3132 - DNA, 2317 bp, Homo sapiens; identical to SEQ ID NO: 3129

SEQ ID NO: 3133 - DNA, 2227 bp, Homo sapiens
gacgacctgtctcgccgagcgcacgcttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaagaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagtt

SEQ ID NO: 3134 - DNA, 2317 bp, Homo sapiens; identical to SEQ ID NO: 3129

SEQ ID NO: 3135 - DNA, 2317 bp, Homo sapiens; identical to SEQ ID NO: 3129

SEQ ID NO: 3136 - DNA, 2317 bp, Homo sapiens; identical to SEQ ID NO: 3129

SEQ ID NO: 3137 - DNA, 1733 bp, Homo sapiens
gcggagagcggtccagagcgagtggaaagatttgggcgagaacttgcgcgggagccggactgagcggtgcgagcgcgcaggcgcggccgacggggcgggctgctactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctatggaaaagctccccttatccaacagagtttaaaagaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaata

SEQ ID NO: 3138 - DNA, 683 bp, Homo sapiens
tggccgcctacaaactggtgctgatccggcacggcgagagcgcatggaacctggagaaccgcttcagcggctggtacgacgccgacctgagcccggcgggccacgaggaggcgaagcgcggcgggcagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaat

SEQ ID NO: 3139 - DNA, 694 bp, Homo sapiens
aaactggtgctgatccggcacggcgagagcgcatggaacctggagaaccgcttcagcggctggtacgacgccgacctgagcccggcgggccacgaggaggcgaagcgcggcgggcaggcgctacgaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtg

SEQ ID NO: 3140 - DNA, 1733 bp, Homo sapiens; identical to SEQ ID NO: 3137

SEQ ID NO: 3141 - DNA, 1574 bp, Homo sapiens
gcggagagcggtccagagcgagtggaaagatttgggcgagaacttgcgcgggagccggactgagcggtgcgagcgcgcaggcgcggccgacggggcgggctgctactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctatggaaaagctccccttatccaacagagtttaaaagaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaata

SEQ ID NO: 3142 - DNA, 1733 bp, Homo sapiens; identical to SEQ ID NO: 3137

SEQ ID NO: 3143 - DNA, 1733 bp, Homo sapiens; identical to SEQ ID NO: 3137

SEQ ID NO: 3144 - DNA, 1574 bp, Homo sapiens; identical to SEQ ID NO: 3141

SEQ ID NO: 3145 - DNA, 683 bp, Homo sapiens; identical to SEQ ID NO: 3138

SEQ ID NO: 3146 - DNA, 986 bp, Homo sapiens
tggccgcctacaaactggtgctgatccggcacggcgagagcgcatggaacctggagaaccgcttcagcggctggtacgacgccgacctgagcccggcgggccacgaggaggcgaagcgcggcgggcagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtg

SEQ ID NO: 3147 - DNA, 1705 bp, Homo sapiens
ccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaataaaaaaaaaaaaaaaaaaaaaa

SEQ ID NO: 3148 - DNA, 1733 bp, Homo sapiens; identical to SEQ ID NO: 3137

SEQ ID NO: 3149 - DNA, 1087 bp, Homo sapiens
ctttcacagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgtaggtatgcagacctcacagaagatcagctaccctcctgtgagagtctgaaggatactattgccagagctctgccttctggaatgaagaaatagttccccagtcaaggaggggaaacgtgtactgattgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaaaaaaaaaaaaaa

SEQ ID NO: 3150 - DNA, 892 bp, Homo sapiens
atggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgaagatctggaggcgctcctatgatgtcccaccacctccgatggagcccgaccatcctttctacagcaacatcagtaaggatcgtaggtatgcagacctcacagaagatcagctaccctcctgtgagagtctgaaggatactattgccagagctctgccttctggaatgaagaaatagttccccagtcaaggaggggaaacgtgtactgattgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaaaaaaaaaaaaaa

SEQ ID NO: 3151 - DNA, 1733 bp, Homo sapiens; identical to SEQ ID NO: 3137

SEQ ID NO: 3152 - DNA, 5695 bp, Homo sapiens
ggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 3153 - DNA, 5715 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 3154 - DNA, 5920 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaagggcaccacctccccctgcctcctcctctccagactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3155 - DNA, 5866 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3156 - DNA, 5925 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 3157 - DNA, 5988 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3158 - DNA, 5829 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3159 - DNA, 5778 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3160 - DNA, 5648 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3161 - DNA, 5988 bp, Homo sapiens; identical to SEQ ID NO: 3157

SEQ ID NO: 3162 - DNA, 5829 bp, Homo sapiens; identical to SEQ ID NO: 3158

SEQ ID NO: 3163 - DNA, 5469 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 3164 - DNA, 5648 bp, Homo sapiens; identical to SEQ ID NO: 3160

SEQ ID NO: 3165 - DNA, 3580 bp, Homo sapiens
ccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctgtatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtgaacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgatgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtcttccatttggataaaaggaaccaaccaacaaacaatgccatcactggaatttcccaccgctttgtgagccgtgtcgtatgacctagtaaactttgtaccaattc

SEQ ID NO: 3166 - DNA, 3962 bp, Homo sapiens
aaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcgtgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtcttccatttggataaaaggaaccaaccaacaaacaatgccatcactggaatttcccaccgctttgtgagccgtgtcgtatgacctagtaaactttgtaccaattc

SEQ ID NO: 3167 - DNA, 3607 bp, Homo sapiens
tggacagagcactggctgggcatcaggactaggctggagtcctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattgggattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgaaacaatgccatcactggaatttcccaccgctttgtgagccgtgtcgtatgacctagtaaactttgtaccaattca

SEQ ID NO: 3168 - DNA, 3636 bp, Homo sapiens
tggacagagcactggctgggcatcaggactaggctggagtctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattgggattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtcttccatttggataaaaggaaccaaccaacaaacaatgccatcactggaatttcccaccgctttgtgagccgtgtcgtatgacctagtaaactttgtaccaattc

SEQ ID NO: 3169 - DNA, 3815 bp, Homo sapiens
aaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtcttccatttggataaaaggaaccaaccaacaaacaatgccatcactggaatttcccaccgctttgtgagccgtgtcgtatgacctagtaaactttgtaccaattc

SEQ ID NO: 3170 - DNA, 3994 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcgtgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaagacccgagtg

SEQ ID NO: 3171 - DNA, 3805 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgaaacaatgccatcactggaatttcccaccgctttgtgagccgtgtcgtatgacctagtaaactttgtaccaattca

SEQ ID NO: 3172 - DNA, 3949 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgaaacaatgccatcactggaatttcccaccgctttgtgagccgtgtcgtatgacctagtaaactttgtaccaattca

SEQ ID NO: 3173 - DNA, 3805 bp, Homo sapiens; identical to SEQ ID NO: 3171

SEQ ID NO: 3174 - DNA, 2345 bp, Homo sapiens
atggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgac

SEQ ID NO: 3175 - DNA, 2865 bp, Homo sapiens
ggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcctggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacct

SEQ ID NO: 3176 - DNA, 1759 bp, Homo sapiens
tttcatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtca

SEQ ID NO: 3177 - DNA, 1722 bp, Homo sapiens
gcgggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcaaagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggtttggggtgtggtgggggggtacccttatttcctcgacacgccgctggctcaaagacaatgttattttccttccctttcttgaagaacaaaaagaaagccgggcatgacggctcatgcctgtaatcccagcactttgggaggctgaggcaggtggatcactggaggtcaggtctttgaggccagccctagccaacatggtgtaaacactgtctctactaaaaatacaattagccaggtgtggcggcgtaatcccatgctaacctgtaatcccagctacttgggaggctgaggcagagctgcttgaaccctggaagtggaggttgcagtgagcctgtcatcgctccactgagccaagatcgctcccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgtaaatctttgacggggttttccttgctcctgccaggattaaaagtccatgagtttcttgctcaaaaaaaaaaaaaaaaaaaaaaaaaaaaaaaaa

SEQ ID NO: 3178 - DNA, 2609 bp, Homo sapiens
gagggaaggaggagctgggtcacagcagggaatcttagcttggttttggtgtgctgctggatgaccagaccgggcgtcgggtgagcccagaagtgagagcagttggctgtgccccagtgctgtgtgacccagaggcgccgctcaccctctctgagctggtggacatcatagcgggtgcagcccagaactgtcttctgaggaagaggtgctctcctgggcccccactgtccccaggcctcagatgctgcatattgctggcccagctcctgaggctctttggacctccaggaatcggtgtctctatcaggaacccttaaccctgacccggactcccagctgggacccggggtgtcggagtggcaagagcactgtcaggcctggtgaagggtgtgagctgtccaacggggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctccccactc

SEQ ID NO: 3179 - DNA, 2244 bp, Homo sapiens
cggggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggtgcctccctggcctgtctccccacaaaaaaaaaaaaaaaaaaaa

SEQ ID NO: 3180 - DNA, 2609 bp, Homo sapiens; identical to SEQ ID NO: 3178

SEQ ID NO: 3181 - DNA, 2609 bp, Homo sapiens; identical to SEQ ID NO: 3178

SEQ ID NO: 3182 - DNA, 2609 bp, Homo sapiens; identical to SEQ ID NO: 3178

SEQ ID NO: 3183 - DNA, 990 bp, Homo sapiens
atggagagctcagaatctggccccagagaagggcagagggaaaggggacccagttcagactctcggccctacatgtctgtgggttccttgtgtgaccaggtgatctacccggactcagtggagggcatgcgaaggaagggctacccggagcaggacctggaagccatcctggacatcgtgcacctgcaccacatcctgcagtgggagggagcccccactgctgggtgtgagatggtcctgggcaaggacctcgccttgctggggctccccttcatgtttcaagggcatgggcaccaagccctccctcggtggcaacataagaagaagtggctcccacaggaaatgaccagggtgttgtcatctgcctgtggaggaagcgggaacacaggttgggaggctatgtgtgactggaaagatgtcctgccgggtggcgagaagcagagaatcggcatggcccgcatgttctaccacaggcccaagtacgccctcctggatgaatgcaccagtgctgtgagcatcgacgtggaaggcaagatcttccaggcggccaaggacgcaggcattgccctgctctccatcacccaccagccctcctgtggtaggtgccctgtctccctgcctggggtcagtgggagtggctgcctgaggggaggaggtggcctgttgggccaggcggcagcagcaggcggctgtcatcagcagccctcgtgccatgcccctgaccctgtccctctcctggccagggagtaccacacacacttgctacagttcgatggggagggtggctggaagttcgagaagctaggctcggctgcccgcctgagcctgacagaggagaagcagcggctggagcagcagctggcgggcattcccaagatgcagcggcacctccaggagctctgccaaatcctgggcgaggccgtggccccagcgcacgtgccggcacctagcccgcaaggccctggtggcctccagggtgcctccacctga

SEQ ID NO: 3184 - DNA, 1464 bp, Homo sapiens
gctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcat

SEQ ID NO: 3185 - DNA, 860 bp, Homo sapiens
gtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagact

SEQ ID NO: 3186 - DNA, 1464 bp, Homo sapiens; identical to SEQ ID NO: 3184

SEQ ID NO: 3187 - DNA, 1763 bp, Homo sapiens
cttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgcaaa

SEQ ID NO: 3188 - DNA, 1484 bp, Homo sapiens
gtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatgaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcat

SEQ ID NO: 3189 - DNA, 2019 bp, Homo sapiens
acctgcccacccttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaatttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgcatttttatgaccacttgtcatttattttgtcttcgtaaattattttcattatatcaaatattttagtatgtacttaataaaataggagaacattttagagtttcaaattcccaggtattttccttgtttattacccctaaatcattcctatttaattcttctttttaaatggagaaaattatgtctttttaatatggtttttgttttgttatatattcacaggctggagacgtttaaaagaccgtttc

SEQ ID NO: 3190 - DNA, 1481 bp, Homo sapiens
cagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaaaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcat

SEQ ID NO: 3191 - DNA, 1381 bp, Homo sapiens
gtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagac

SEQ ID NO: 3192 - DNA, 1857 bp, Homo sapiens
ttccagtgggaggaagagcgaagaagagaaggaggtagataagctagcgaaaagaaggaggtagacaagctagcaaagcgaaggtgcagaattagaaaagttaccaggacagggcaggggagttcctcatgtccacagcaggccttgctcccctggccggagcccaggggagggagacggaggaaggcagccacttttccagtgagaagttgagcaaggagttggcacccggccctctctacctctagagaaaagggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagacta

SEQ ID NO: 3193 - DNA, 956 bp, Homo sapiens
gtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcat

SEQ ID NO: 3194 - DNA, 1514 bp, Homo sapiens
gtgacagtgctgacactacaaggctcggagctccgggcactcagacatcatgattctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagac

SEQ ID NO: 3195 - DNA, 1605 bp, Homo sapiens
actggaagaagttgcatcacacagcctccaggactgccctcctcctcacagcaatggataatgcttcactagcctttgcagataattttggatcagagaaaaaaccttgagctgggccaaaaaggaggagcttcaacctgtgtgcaaaatctgggaacctgacagtataggttgggggccaggatgaggaaaaaggaacgggaaagacctgcccacccttctgtatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagact

SEQ ID NO: 3196 - DNA, 841 bp, Homo sapiens
gtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagactagatac

SEQ ID NO: 3197 - DNA, 1508 bp, Homo sapiens
gtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaacctttt

SEQ ID NO: 3198 - DNA, 1553 bp, Homo sapiens
ggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcgaaccttgcaaagacacggtgcaaatccatgatatcactgggaaaggtaaattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagacta

SEQ ID NO: 3199 - DNA, 15471 bp, Homo sapiens
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagccccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccgaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaactcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaatggatggatggatggatggat

SEQ ID NO: 3200 - DNA, 14760 bp, Homo sapiens; identical to SEQ ID NO: 3009

SEQ ID NO: 3201 - DNA, 14760 bp, Homo sapiens; identical to SEQ ID NO: 3009

SEQ ID NO: 3202 - DNA, 2924 bp, Homo sapiens
gacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagaaaacaaaaaaa

SEQ ID NO: 3203 - DNA, 3372 bp, Homo sapiens
tgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagcacagcct

SEQ ID NO: 3204 - DNA, 2924 bp, Homo sapiens
gggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagcacagcct

(The sequence listing continues in the following parts.)

---

The invention claimed is:

1. A method of diagnosing kidney cancer in an individual, the method comprising detecting an elevated level of ABC 1 protein in a sample from the individual as compared to a control ABC 1 protein level of an individual who does not have kidney cancer, wherein the elevated level of ABC1 protein indicates that said individual has kidney cancer, wherein the amino acid sequence of the ABC1 protein comprises a sequence selected from the group consisting of SEQ ID NOS: 275-276.

2. The method of claim 1, wherein the amino acid sequence of the ABC1 protein consists of a sequence selected from the group consisting of SEQ ID NOS: 275-276.

3. The method of claim 1, wherein the higher level of ABC 1 protein is detected by contacting the sample with an isolated antibody that selectively binds to the ABC 1 protein and detecting binding of the antibody to the ABC 1 protein.

4. The method of claim 3, wherein the antibody is coupled to a detectable substance.

* * * * *

UNITED STATES PATENT AND TRADEMARK OFFICE
CERTIFICATE OF CORRECTION

PATENT NO. : 7,608,413 B1  Page 1 of 1
APPLICATION NO. : 11/878050
DATED : October 27, 2009
INVENTOR(S) : Elizabeth Joseloff et al.

It is certified that error appears in the above-identified patent and that said Letters Patent is hereby corrected as shown below:

In the Specification:

In Columns 73 and 74, please insert the following page-wide LENGTHY TABLES statement so that it immediately precedes the page-wide SEQUENCE LISTING statement:

---

-- LENGTHY TABLES

The patent contains a lengthy table section. A copy of the table is available in electronic form from the USPTO web site (http://seqdata.uspto.gov/?pageRequest=docDetail&DocID=US07608413B1). An electronic copy of the table will also be available from the USPTO upon request and payment of the fee set forth in 37 CFR 1.19(b)(3). --

---

Signed and Sealed this

Sixth Day of July, 2010

David J. Kappos
*Director of the United States Patent and Trademark Office*